(12) United States Patent
Powers et al.

(10) Patent No.: US 11,786,546 B2
(45) Date of Patent: Oct. 17, 2023

(54) COMPOUNDS AND METHODS FOR MODULATING GFAP

(71) Applicant: Ionis Pharmaceuticals, Inc., Carlsbad, CA (US)

(72) Inventors: Berit Elissa Powers, San Marcos, CA (US); Frank Rigo, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 300 days.

(21) Appl. No.: 16/938,826

(22) Filed: Jul. 24, 2020

(65) Prior Publication Data

US 2021/0038629 A1 Feb. 11, 2021

Related U.S. Application Data

(60) Provisional application No. 62/878,998, filed on Jul. 26, 2019.

(51) Int. Cl.
*A61K 31/712* (2006.01)
*A61K 31/7125* (2006.01)
*A61P 25/28* (2006.01)
*C12N 15/113* (2010.01)

(52) U.S. Cl.
CPC ........ *A61K 31/712* (2013.01); *A61K 31/7125* (2013.01); *A61P 25/28* (2018.01); *C12N 15/113* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |

(Continued)

FOREIGN PATENT DOCUMENTS

| | | | |
|---|---|---|---|
| WO | 2006006948 A2 | 1/2006 | |
| WO | WO-2013022984 A1 * | 2/2013 | ........... C12N 15/111 |

(Continued)

OTHER PUBLICATIONS

Quinlan et al., "GFAP and its role in Alexander disease" Experimental Cell Research vol. 313 pp. 2077-2087 doi:10.1016/j.yexcr.2007.04.004 (Year: 2007).*
Kimura et al., "Clinical characteristics of autoimmune GFAP astrocytopathy" Journal of Neuroimmunology vol. 332 pp. 91-98 https://doi.org/10.1016/j.jneuroim.2019.04.004 (Year: 2019).*
Abdelhak et al., "Blood GFAP as an emerging biomarker in brain and spinal cord disorders" Nature Reviews Neurology vol. 18 pp. 158-172 https://doi.org/10.1038/s41582-021-00616-3 (Year: 2022).*
Messing et al., "GFAP at50"ASN Neurology vol. 0 pp. 1-23 DOI: 10.1177/1759091420949680 (Year: 2020).*
Smith et al., "Therapeutic Oligonucleotides: State of the Art" Annual Review of Pharmacology and Toxicology vol. 59 pp. 605-630 (Year: 2019).*
Branch et al., "A good antisense molecule is hard to find," TIBS (1998) 23:45-50.

(Continued)

*Primary Examiner* — Eric Olson
(74) *Attorney, Agent, or Firm* — Banner & Witcoff, Ltd.

(57) ABSTRACT

Provided are compounds, methods, and pharmaceutical compositions for reducing the amount or activity of GFAP RNA in a cell or subject, and in certain instances reducing the amount of GFAP in a cell or subject. Such compounds, methods, and pharmaceutical compositions are useful to ameliorate at least one symptom or hallmark of a leukodystrophy. Such symptoms and hallmarks include motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers. Such leukodystrophies include Alexander Disease.

42 Claims, No Drawings

Specification includes a Sequence Listing.

(56) References Cited

U.S. PATENT DOCUMENTS

| | | |
|---|---|---|
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Summerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Buhr et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 7,015,315 B1 | 3/2006 | Cook et al. |
| 7,034,133 B2 | 4/2006 | Wengel et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,888,497 B2 | 2/2011 | Bentwich et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,090,542 B2 | 1/2012 | Khvorova et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,372,808 B2 | 2/2013 | Messing et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,550,988 B2 * | 1/2017 | Swayze .............. A61K 31/7125 |
| 2001/0053519 A1 | 12/2001 | Fodor et al. |
| 2003/0082807 A1 | 5/2003 | Wengel |
| 2003/0158403 A1 | 8/2003 | Manoharan et al. |
| 2003/0175906 A1 | 9/2003 | Manoharan et al. |
| 2003/0207841 A1 | 11/2003 | Kaneko et al. |
| 2003/0224377 A1 | 12/2003 | Wengel et al. |
| 2003/0228597 A1 | 12/2003 | Cowsert et al. |
| 2004/0143114 A1 | 7/2004 | Imanishi et al. |
| 2004/0171570 A1 | 9/2004 | Allerson et al. |

(56) References Cited

U.S. PATENT DOCUMENTS

| | | |
|---|---|---|
| 2004/0192918 A1 | 9/2004 | Imanishi et al. |
| 2005/0130923 A1 | 6/2005 | Bhat et al. |
| 2005/0255487 A1 | 11/2005 | Khvorova et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2008/0011335 A1 | 5/2008 | Naito et al. |
| 2008/0113351 A1 | 5/2008 | Naito et al. |
| 2010/0190837 A1 | 7/2010 | Migawa et al. |
| 2010/0197762 A1 | 8/2010 | Swayze et al. |
| 2011/0123520 A1 | 5/2011 | Manoharan et al. |
| 2013/0130378 A1 | 5/2013 | Manoharan et al. |
| 2013/0203836 A1 | 8/2013 | Rajeev et al. |
| 2013/0237585 A1* | 9/2013 | Bennett .............. C12N 15/1137 536/24.5 |
| 2014/0107330 A1 | 4/2014 | Freier et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |

FOREIGN PATENT DOCUMENTS

| | | |
|---|---|---|
| WO | 2013173635 A1 | 11/2013 |
| WO | WO 2019/089692 | 5/2019 |
| WO | 2021021673 A1 | 2/2021 |

OTHER PUBLICATIONS

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Gautschi et al., "Activity of a novel bcl-2/bcl-xLbispecific antisense oligonucleotide against tumors of diverse histologic origins" J. Natl. Cancer Inst. (2001) 93:463-471.
Maher et al., "Comparative hybrid arrest by tandem antisense oligodeoxy ribonucleotides or oligodeoxyribonucleoside methylpbosphonates in a cell-free system" Nucl. Acid. Res. (1988) 16(8):3341-3358.
Prust et al., "GFAP mutations, age at onset, and clinical subtypes in Alexander disease" Neurology (2011) 77: 1287-1294.
New England Biolabs 1998/99 Catalog (cover page and pp. 121 and 284).

Messing et al., "Strategies for treatment in Alexander disease" Neurotherapeutics (2010) 7: 507-515.
Messing et al., "Fatal encephalopathy with astrocyte inclusions in GFAP transgenic mice" Am J Pathol (1998) 152: 391-398.
Reynolds et al., "Rational siRNA design for RNA interference" Nature Biotechnology (2004) 22(3):326-330.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Woolf et al., "Specificity of antisense oligonucleotides in vivo" PNAS (1992) 89: 7305-7309.
Hagemann et al., "Antisense suppression of glial fibrillary acidic protein as a treatment for Alexander disease" Ann Neurol (2018) 83: 27-39.
International Search Report for PCT/US20/043602 dated Dec. 15, 2020.
Austin & Moalem-Taylor, "The neuro-immune balance in neuropathic pain: Involvement of inflammatory immune cells, immune-like glial cells and cytokines," Journal of Neuroimmunology 229, 26-30, 2010.
European search report for application No. 20846055.0, dated Oct. 13, 2022.
Kanski et al., "Histone acetylation in astrocytes suppresses GFAP and stimulates a reorganization of the intermediate filament network," Journal of Cell Science 127, 4368-80, 2014.
Kim et al., "Profiling of Dynamically Changed Gene Expression in Dorsal Root Ganglia Post Peripheral Nerve Injury and a Critical Role of Injury-Induced Glial Fibrillary Acetic Protein in Maintenance of Pain Behaviors," Pain 143, 114-22, 2009.
Middeldorp, "GFAP in health and disease," Progress in Neurobiology 93, 421-43, 2011.
Powers et al., "Antisense Oligonucleotide Therapy Elicits Rapid, Sustained Pathology Reversal in a Mouse Model of Alexander Disease," Presentation # 475.12, Society for Neuroscience 47th Annual Meeting, Nov. 11-15, 2017.
Powers et al., "Antisense Oligonucleotides (AASOs) Targeting Mouse Gfap Reverse Pathology in a Model of Alexander Disease," Presentation # 692.05, Society for Neuroscience 46th Annual Meeting, Nov. 12-16, 2016.
Rothstein et al., "Knockout of Glutamate Transporters Reveals a Major Role for Astroglial Transport in Excitotoxicity and Clearance of Glutamate," Neuron 16, 675-86, 1996.
Yu et al., "Astrogliosis in Culture: I. The Model and the Effect of Antisense Oligonucleotides on Glial Fibrillary Acidic Protein Synthesis," Journal of Neuroscience Research 34, 295-303, 1993.
Yu et al., "Inhibition of GFAP Synthesis with Antisense Nucleic Acid Constructs," in Biology and Pathology of Astrocyte-Neuron Interactions, Fedoroff et al., eds , Plenum Press, New York, pp. 313-325, 1993.

* cited by examiner

COMPOUNDS AND METHODS FOR MODULATING GFAP

SEQUENCE LISTING

The present application is being filed along with a Sequence Listing in electronic format. The Sequence Listing is provided as a file entitled BIOL0353UWOSEQ_ST25.txt, created on Jul. 17, 2020, which is 592 KB in size. The information in the electronic format of the sequence listing is incorporated herein by reference in its entirety.

FIELD

Provided are compounds, methods, and pharmaceutical compositions for reducing the amount or activity of GFAP RNA in a cell or subject, and in certain instances reducing the amount of glial fibrillary acidic protein (GFAP) in a cell or subject. Such compounds, methods, and pharmaceutical compositions are useful to ameliorate at least one symptom or hallmark of a leukodystrophy. Such symptoms and hallmarks include motor delays, cognitive delays, paroxysmal deterioration, seizures, vomiting, swallowing difficulties, ataxic gait, palatal myoclonus, autonomic dysfunction, and intra-astrocytic inclusions called Rosenthal fibers. Such leukodystrophies include Alexander Disease.

BACKGROUND

Alexander Disease (AxD) is a rare developmental disorder that affects ~1/1,000,000 live births and is caused by a number of different autosomal dominant mutations in the gene encoding glial fibrillary acidic protein, GFAP. AxD is a typically fatal leukodystrophy with early onset (<age 4, Type I) or later onset (>age 4 Type II) forms (Prust et al., (2011) GFAP mutations, age at onset, and clinical subtypes in Alexander disease. Neurol 77: 1287-1294). Symptoms include motor and cognitive delays, paroxysmal deterioration, seizures, encephalopathy, macrocephaly, and intra-astrocytic inclusions called Rosenthal fibers.

There are no specific therapies for AxD, with current treatments being limited to supportive treatments for individual symptoms (e.g., antiepileptics to prevent seizures; Messing, et. al., "Strategies for treatment in Alexander Disease", *Neurotherapeutics: The Journal of the Am. Soc. For Expt. NeuroTher.*, 2016).

Currently there is a lack of acceptable options for treating leukodystrophies such as AxD. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of GFAP RNA, and in certain embodiments reducing the expression of glial fibrillary acidic protein in a cell or subject. In certain embodiments, the subject has a leukodystrophy. In certain embodiments, the subject has Alexander Disease (AxD). In certain embodiments, compounds useful for reducing the amount or activity of GFAP RNA are oligomeric compounds. In certain embodiments, compounds useful for reducing the amount or activity of GFAP RNA are modified oligonucleotides. In certain embodiments, compounds useful for decreasing expression of glial fibrillary acidic protein are oligomeric compounds. In certain embodiments, compounds useful for decreasing expression of glial fibrillary acidic protein are modified oligonucleotides.

Also provided are methods useful for ameliorating at least one symptom or hallmark of a leukodystrophy. In certain embodiments, the leukodystrophy is Alexander Disease. In certain embodiments, the symptom or hallmark includes motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, treatises, and GenBank, ENSEMBL, and NCBI reference sequence records, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyfuranosyl sugar moiety. In certain embodiments, a 2'-deoxynucleoside is a 2'-β-D-deoxynucleoside and comprises a 2'-β-D-deoxyribosyl sugar moiety, which has the β-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" or "2'-MOE sugar moiety" means a 2'-OCH$_2$CH$_2$OCH$_3$ group in place of the 2'-OH group of a furanosyl sugar moiety. A "2'-MOE sugar moiety" means a sugar moiety with a 2'-OCH$_2$CH$_2$OCH$_3$ group in place of the 2'-OH group of a furanosyl sugar moiety. Unless otherwise indicated, a 2'-MOE sugar moiety is in the β-D-ribosyl configuration. "MOE" means O-methoxyethyl.

As used herein, "2'-MOE nucleoside" means a nucleoside comprising a 2'-MOE sugar moiety.

As used herein, "2'-OMe" or "2'-O-methyl sugar moiety" means a 2'-OCH$_3$ group in place of the 2'-OH group of a furanosyl sugar moiety. A "2'-O-methyl sugar moiety" or "2'-OMe sugar moiety" means a sugar moiety with a 2'-OCH$_3$ group in place of the 2'-OH group of a furanosyl sugar moiety. Unless otherwise indicated, a 2'-OMe sugar moiety is in the β-D-ribosyl configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methylcytosine" means a cytosine modified with a methyl group attached to the 5 position. A 5-methylcytosine is a modified nucleobase.

As used herein, "administering" means providing a pharmaceutical agent to a subject.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom or hallmark relative to the same symptom or hallmark in the absence of the treatment. In certain embodiments, amelioration is the reduction in the severity or frequency of a symptom or the delayed onset or slowing of progression in the severity or frequency of a symptom. In certain embodiments, the symptom or hallmark is motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the furanosyl sugar moiety is a ribosyl moiety. In certain embodiments, the bicyclic sugar moiety does not comprise a furanosyl moiety.

As used herein, "cerebrospinal fluid" or "CSF" means the fluid filling the space around the brain and spinal cord. "Artificial cerebrospinal fluid" or "aCSF" means a prepared or manufactured fluid that has certain properties of cerebrospinal fluid.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more portions thereof and the nucleobases of another nucleic acid or one or more portions thereof are capable of hydrogen bonding with one another when the nucleobase sequence of the oligonucleotide and the other nucleic acid are aligned in opposing directions. As used herein, "complementary nucleobases" means nucleobases that are capable of forming hydrogen bonds with one another. Complementary nucleobase pairs include adenine (A) and thymine (T), adenine (A) and uracil (U), cytosine (C) and guanine (G), 5-methylcytosine ($^m$C) and guanine (G). Complementary oligonucleotides and/or target nucleic acids need not have nucleobase complementarity at each nucleoside. Rather, some mismatches are tolerated. As used herein, "fully complementary" or "100% complementary" in reference to an oligonucleotide, or a portion thereof, means that the oligonucleotide, or portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar moiety" means a 4' to 2' bridge in place of the 2'OH-group of a ribosyl sugar moiety, wherein the bridge has the formula of 4'─CH(CH$_3$)─O-2' and wherein the methyl group of the bridge is in the S configuration. A "cEt sugar moiety" is a bicyclic sugar moiety with a 4' to 2' bridge in place of the 2'OH-group of a ribosyl sugar moiety, wherein the bridge has the formula 4'─CH(CH$_3$)─O-2' and wherein the methyl group of the bridge is in the S configuration.

As used herein, "cEt nucleoside" means a nucleoside comprising a cEt sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "chirally controlled" in reference to an internucleoside linkage means chirality at that linkage is enriched for a particular stereochemical configuration.

As used herein, "deoxy region" means a region of 5-12 contiguous nucleotides, wherein at least 70% of the nucleosides are 2'-β-D-deoxynucleosides. In certain embodiments, each nucleoside is selected from a 2'-β-D-deoxynucleoside, a bicyclic nucleoside, and a 2'-substituted nucleoside. In certain embodiments, a deoxy region supports RNase H activity. In certain embodiments, a deoxy region is the gap or internal region of a gapmer.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." The internal region is a deoxy region. The positions of the internal region or gap refer to the order of the nucleosides of the internal region and are counted starting from the 5'-end of the internal region. Unless otherwise indicated, "gapmer" refers to a sugar motif. Unless otherwise indicated, the sugar moiety of each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap are 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage or "PS internucleoside linkage" is a modified internucleoside linkage in which one of the non-bridging oxygen atoms of a phosphodiester internucleoside linkage is replaced with a sulfur atom.

As used herein, "leukodystrophy" means a disorder due to abnormalities in the myelin sheath of neurons.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methylcytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein, "nucleoside" means a compound, or a fragment of a compound, comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard in vitro assay" means the assay described in Example 1 and reasonable variations thereof.

As used herein, "standard in vivo assay" means the assay described in Example 7 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal.

As used herein, "sugar moiety" means an unmodified sugar moiety or a modified sugar moiety. As used herein, "unmodified sugar moiety" means a 2'-OH(H) β-D-ribosyl moiety, as found in RNA (an "unmodified RNA sugar moiety"), or a 2'-H(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests. In certain embodiments, a hallmark is apparent on a brain MRI scan.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease.

Certain Embodiments

The present disclosure provides the following non-limiting numbered embodiments:

Embodiment 1: An oligomeric compound comprising a modified oligonucleotide consisting of 12 to 30 linked nucleosides wherein the nucleobase sequence of the modified oligonucleotide is at least 90% complementary to an equal length portion of a GFAP nucleic acid, and wherein the modified oligonucleotide comprises at least one modification selected from a modified sugar moiety and a modified internucleoside linkage.

Embodiment 2: An oligomeric compound comprising a modified oligonucleotide consisting of 12 to 30 linked nucleosides and having a nucleobase sequence comprising at least 12, at least 13, at least 14, at least 15, at least 16, at least 17, at least 18, at least 19, or 20 contiguous nucleobases of any of SEQ ID NOs: 20-2809 or 2813, wherein the modified oligonucleotide comprises at least one modification selected from a modified sugar moiety and a modified internucleoside linkage.

Embodiment 3: An oligomeric compound comprising a modified oligonucleotide consisting of 12 to 30 linked nucleosides and having a nucleobase sequence comprising at least 12, at least 13, at least 14, at least 15, at least 16, at least 17, or 18 contiguous nucleobases of any of SEQ ID NOs: 2816-2837, 2839-2846, 2850-2854, 2856, 2859, 2861-2863, 2866, 2873-2876, 2886-2888, 2891, wherein the modified oligonucleotide comprises at least one modification selected from a modified sugar moiety and a modified internucleoside linkage.

Embodiment 4: An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to:
an equal length portion of nucleobases 9324-9348 of SEQ ID NO: 2;
an equal length portion of nucleobases 9459-9480 of SEQ ID NO: 2;
an equal length portion of nucleobases 9530-9580 of SEQ ID NO: 2;
an equal length portion of nucleobases 12006-12038 of SEQ ID NO: 2; or
an equal length portion of nucleobases 13038-13058 of SEQ ID NO: 2,
wherein the modified oligonucleotide comprises at least one modification selected from a modified sugar moiety and a modified internucleoside linkage.

Embodiment 5: An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, or at least 18 contiguous nucleobases of a sequence selected from:
SEQ ID Nos: 21, 1177, 2321, 2398, 2808-2809, 2840-2842, 2853-2854;
SEQ ID Nos: 555, 2093, 2170, 2813;
SEQ ID Nos: 20, 88, 166, 1331, 1408, 1485, 1637, 1713, 1714, 1789, 1790, 1637, 1638, 1865, 1866, 1941, 2018, 2095, 2172, 2249, 2326, 2403, 2480, 2557, 2633, 2709, 2785, 2816-2818, 2859, 2861, 2886-2887;
SEQ ID Nos: 815, 893, 971, 1049, 1269, 1270, 1346, 1423, 1499, 1500, 1660, 1736, 2655, 2731; or
SEQ ID Nos: 825, 1973.

Embodiment 6: The oligomeric compound of any of embodiments 1-5, wherein the modified oligonucleotide has a nucleobase sequence that is at least 80%, at least 85%, at least 90%, at least 95%, or 100% complementary to the nucleobase sequence of SEQ ID NO: 1, SEQ ID NO: 2 or SEQ ID NO: 3 when measured across the entire nucleobase sequence of the modified oligonucleotide.

Embodiment 7: The oligomeric compound of any of embodiments 1-6, wherein the modified oligonucleotide comprises at least one modified sugar moiety.

Embodiment 8: The oligomeric compound of embodiment 7, wherein the modified oligonucleotide comprises at least one bicyclic sugar moiety.

Embodiment 9: The oligomeric compound of embodiment 8, wherein the bicyclic sugar moiety has a 4'-2' bridge, wherein the 4'-2' bridge is selected from $CH_2$—O—; and —$CH(CH_3)$—O—.

Embodiment 10: The oligomeric compound of any of embodiments 1-9, wherein the modified oligonucleotide comprises at least one non-bicyclic modified sugar moiety.

Embodiment 11: The oligomeric compound of embodiment 10, wherein the non-bicyclic modified sugar moiety is a 2'-MOE sugar moiety or a 2'-OMe sugar moiety.

Embodiment 12: The oligomeric compound of any of embodiments 1-11, wherein the modified oligonucleotide comprises at least one sugar surrogate.

Embodiment 13: The oligomeric compound of embodiment 12, wherein the sugar surrogate is any of morpholino, modified morpholino, PNA, THP, and F-HNA.

Embodiment 14: The oligomeric compound of any of embodiments 1-7 or 10-13, wherein the modified oligonucleotide does not comprise a bicyclic sugar moiety.

Embodiment 15: The oligomeric compound of any of embodiments 1-14, wherein the modified oligonucleotide is a gapmer.

Embodiment 16: The oligomeric compound of any of embodiments 1-15, wherein the modified oligonucleotide comprises:
a 5'-region consisting of 1-6 linked nucleosides;
a central region consisting of 6-10 linked nucleosides; and
a 3'-region consisting of 1-6 linked nucleosides;
wherein each of the 5'-region nucleosides and each of the 3'-region nucleosides comprises a modified sugar moiety and at least one of the central region nucleosides comprises a 2'-deoxyribosyl sugar moiety.

Embodiment 17: The oligomeric compound of embodiment 16, wherein the modified oligonucleotide comprises
a 5'-region consisting of 6 linked nucleosides;
a central region consisting of 10 linked nucleosides; and
a 3'-region consisting of 4 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 18: The oligomeric compound of embodiment 16, wherein the modified oligonucleotide comprises:
a 5'-region consisting of 5 linked nucleosides;
a central region consisting of 10 linked nucleosides; and
a 3'-region consisting of 5 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 19: The oligomeric compound of embodiment 16, wherein the modified oligonucleotide comprises:
a 5'-region consisting of 4 linked nucleosides;
a central region consisting of 10 linked nucleosides; and
a 3'-region consisting of 6 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 20: The oligomeric compound of embodiment 16, wherein the modified oligonucleotide comprises
a 5'-region consisting of 5 linked nucleosides;
a central region consisting of 8 linked nucleosides; and
a 3'-region consisting of 5 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 21: The oligomeric compound of any of embodiments 1-20, wherein the modified oligonucleotide comprises at least one modified internucleoside linkage.

Embodiment 22: The oligomeric compound of embodiment 21, wherein each internucleoside linkage of the modified oligonucleotide is a modified internucleoside linkage.

Embodiment 23: The oligomeric compound of embodiments 21 or 22, wherein the modified internucleoside linkage is a phosphorothioate internucleoside linkage.

Embodiment 24: The oligomeric compound of any one of embodiments 1-21, wherein the modified oligonucleotide comprises at least one phosphodiester internucleoside linkage.

Embodiment 25: The oligomeric compound of any of embodiments 21, 23, or 24, wherein each internucleoside linkage is either a phosphodiester internucleoside linkage or a phosphorothioate internucleoside linkage.

Embodiment 26: The oligomeric compound of any one of embodiments 1-21 or 23-25, wherein the modified oligonucleotide has an internucleoside linkage motif selected from among: sooosssssssssssooss, sooooossssssssssoss, soooossssssssssooss, sooossssssssssooss, or sooosssssssssssoooss; wherein, s=a phosphorothioate internucleoside linkage and o=a phosphodiester internucleoside linkage.

Embodiment 27: The oligomeric compound of any of embodiments 1-26, wherein the modified oligonucleotide comprises at least one modified nucleobase.

Embodiment 28: The oligomeric compound of embodiment 27, wherein the modified nucleobase is a 5-methylcytosine.

Embodiment 29: The oligomeric compound of any of embodiments 1-28, wherein the modified oligonucleotide consists of 12-30, 12-22, 12-20, 14-18, 14-20, 15-17, 15-25, 16-20, 18-22 or 18-20 linked nucleosides.

Embodiment 30: The oligomeric compound of any of embodiments 1-29, wherein the modified oligonucleotide consists of 18 linked nucleosides.

Embodiment 31: The oligomeric compound of any of embodiments 1-30, wherein the modified oligonucleotide consists of 20 linked nucleosides.

Embodiment 32: The oligomeric compound of any of embodiments 1-31, consisting of the modified oligonucleotide.

Embodiment 33: An oligomeric duplex comprising an oligomeric compound of any of embodiments 1-31.

Embodiment 34: An antisense compound comprising or consisting of an oligomeric compound of any of embodiments 1-32 or an oligomeric duplex of embodiment 33.

Embodiment 35: A pharmaceutical composition comprising an oligomeric compound of any of embodiments 1-32 or an oligomeric duplex of embodiment 33 and a pharmaceutically acceptable carrier or diluent.

Embodiment 36: The pharmaceutical composition of embodiment 35, wherein the pharmaceutically acceptable diluent is artificial cerebral spinal fluid.

Embodiment 37: The pharmaceutical composition of embodiment 36, wherein the pharmaceutical composition consists of the modified oligonucleotide and phosphate buffered saline.

Embodiment 38: A method comprising administering to a subject a pharmaceutical composition of any of embodiments 35-37.

Embodiment 39: A method of treating a disease associated with GFAP comprising administering to an individual having or at risk for developing a disease associated with GFAP a therapeutically effective amount of a compound of any one of embodiments 1-34 or a pharmaceutical composition according to any of embodiments 35-37; and thereby treating the disease associated with GFAP.

Embodiment 40: The method of embodiment 39, wherein the GFAP-associated disease is Alexander Disease.

Embodiment 41: The method of any of embodiments 38-40, wherein at least one symptom or hallmark of the GFAP-associated disease is ameliorated.

Embodiment 42: The method of embodiment 41, wherein the symptom or hallmark is motor delays, cognitive delays, paroxysmal deterioration, seizures, vomiting, swallowing difficulties, ataxic gait, palatal myoclonus, autonomic dysfunction, or the presence of intra-astrocytic inclusions called Rosenthal fibers.

Embodiment 43: The method of any of embodiments 38-42, wherein GFAP levels in the individual are reduced.

Embodiment 44: A modified oligonucleotide according to the following chemical structure:
(SEQ ID NO: 20)
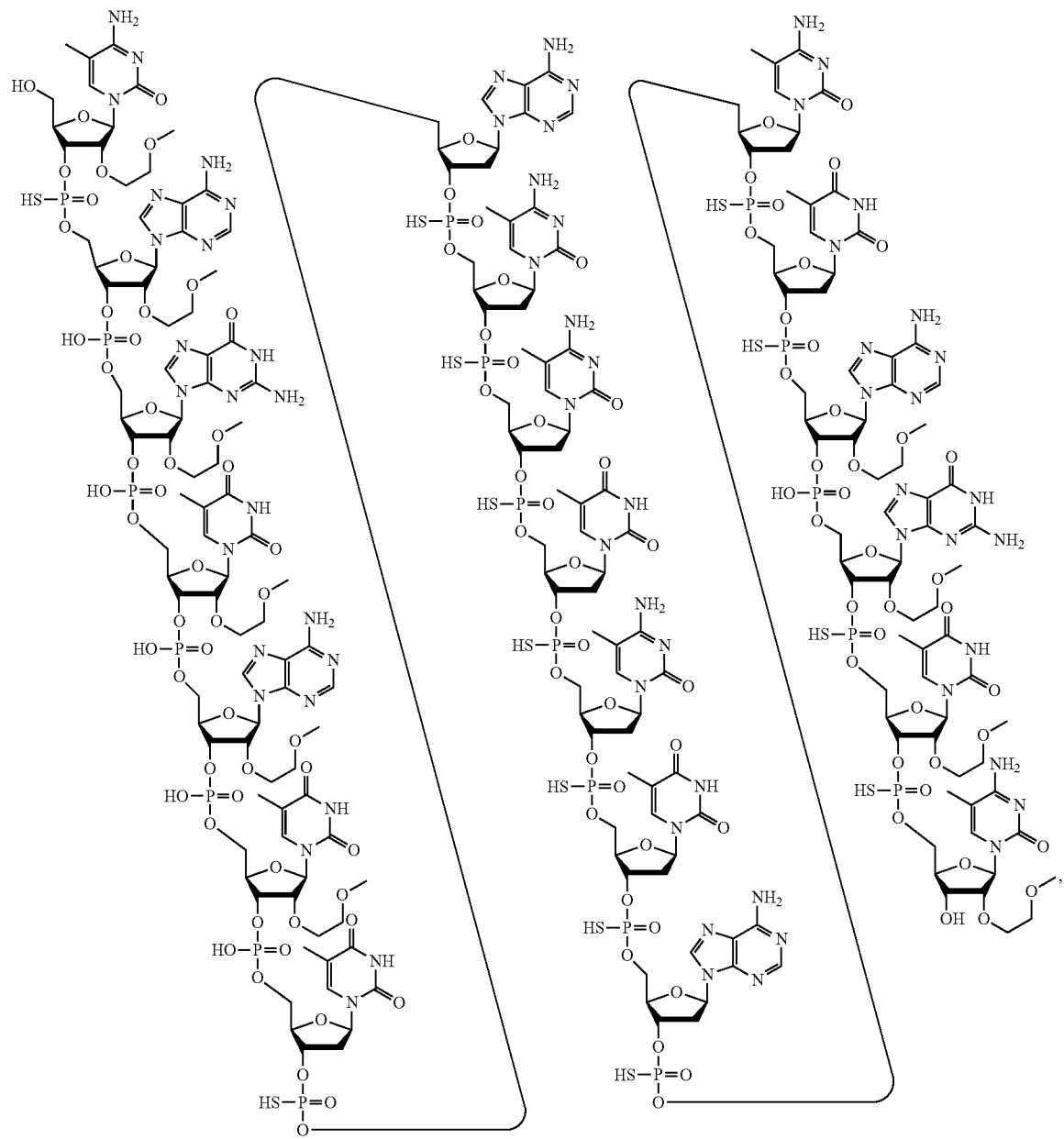
or a salt thereof.

Embodiment 45: A modified oligonucleotide according to the following chemical structure:
(SEQ ID NO: 20)
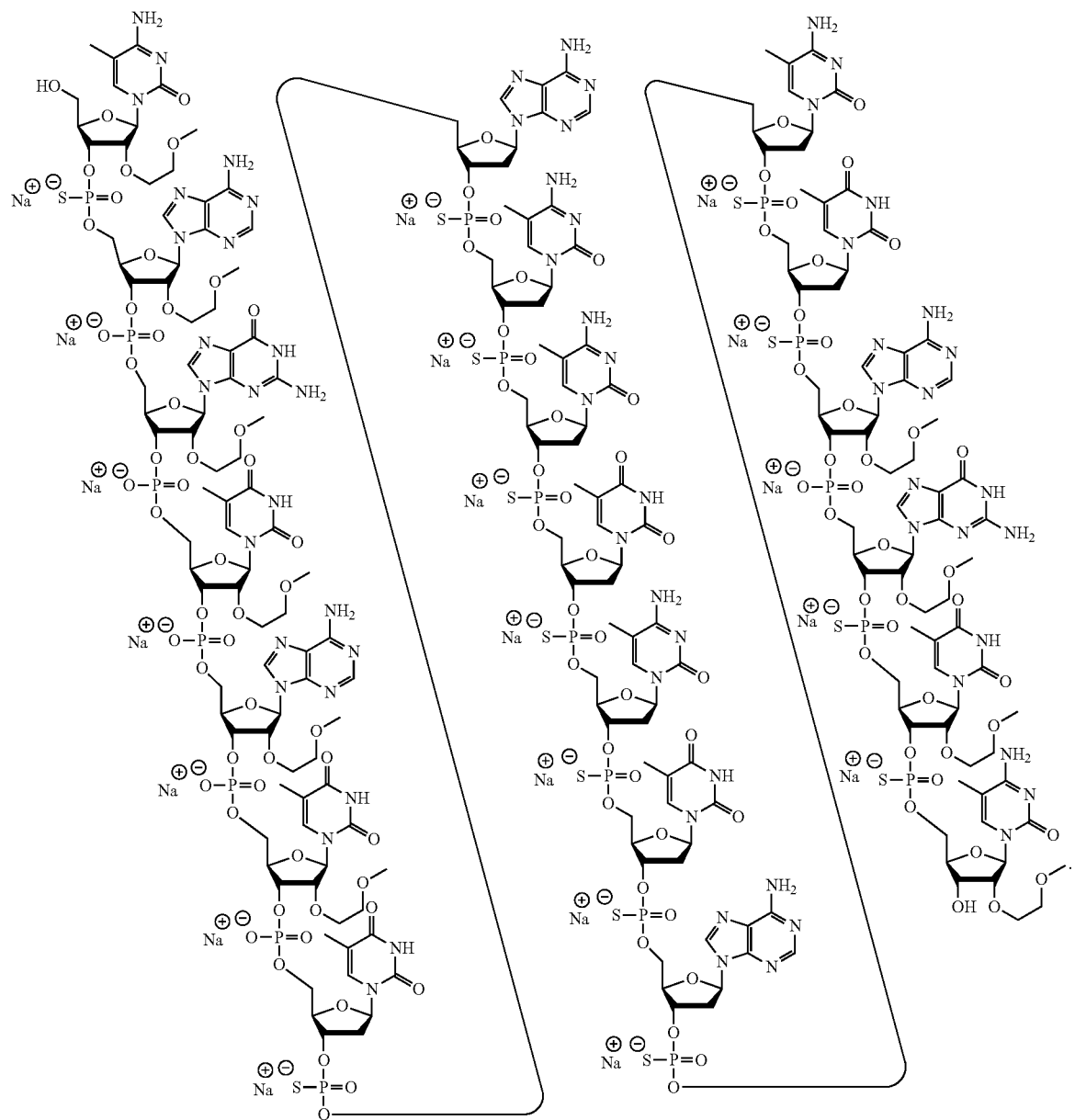

Embodiment 46: A modified oligonucleotide according to the following chemical structure:
(SEQ ID NO: 21)
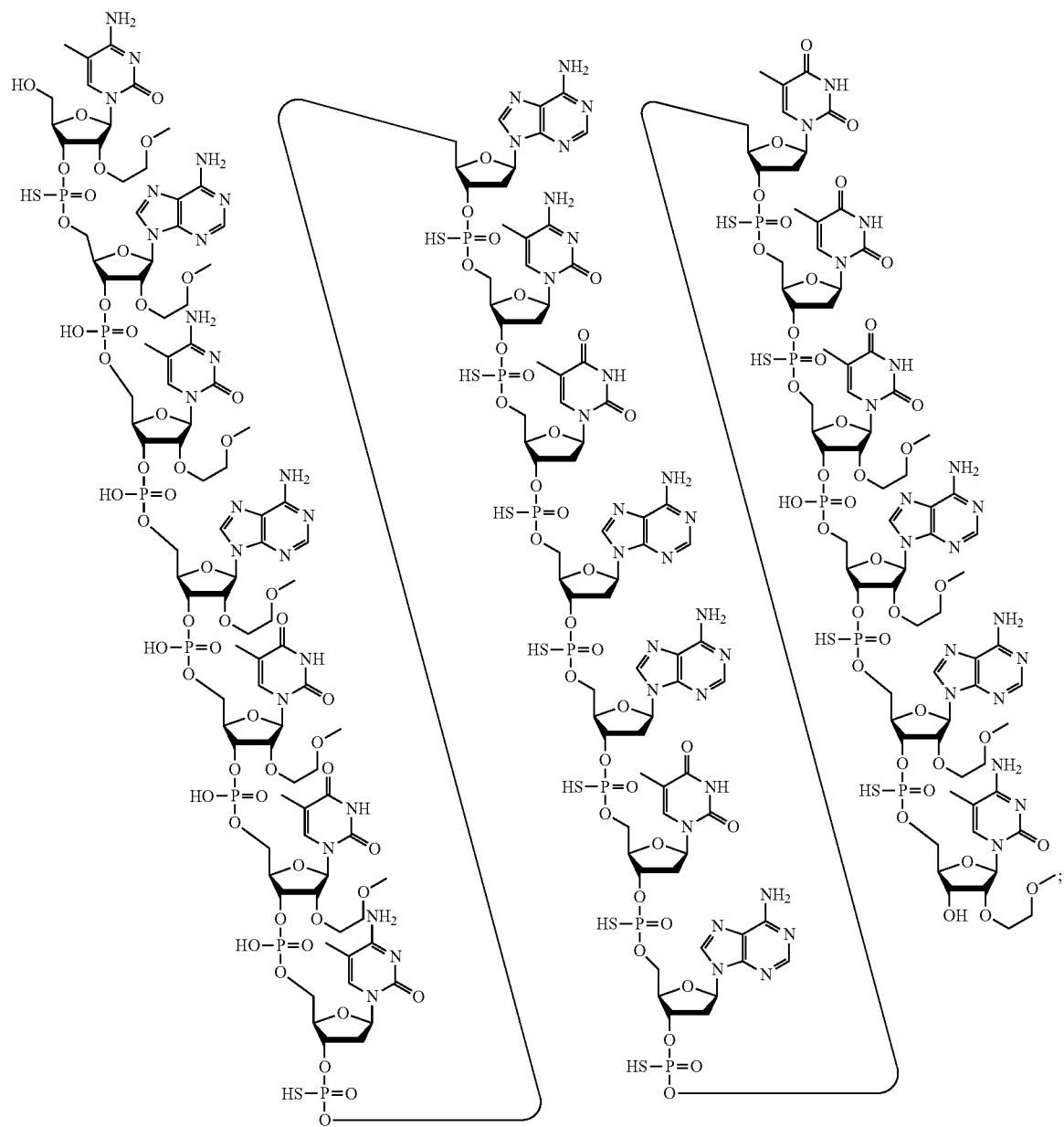
or a salt thereof.

Embodiment 47: A modified oligonucleotide according to the following chemical structure:
(SEQ ID NO: 21)
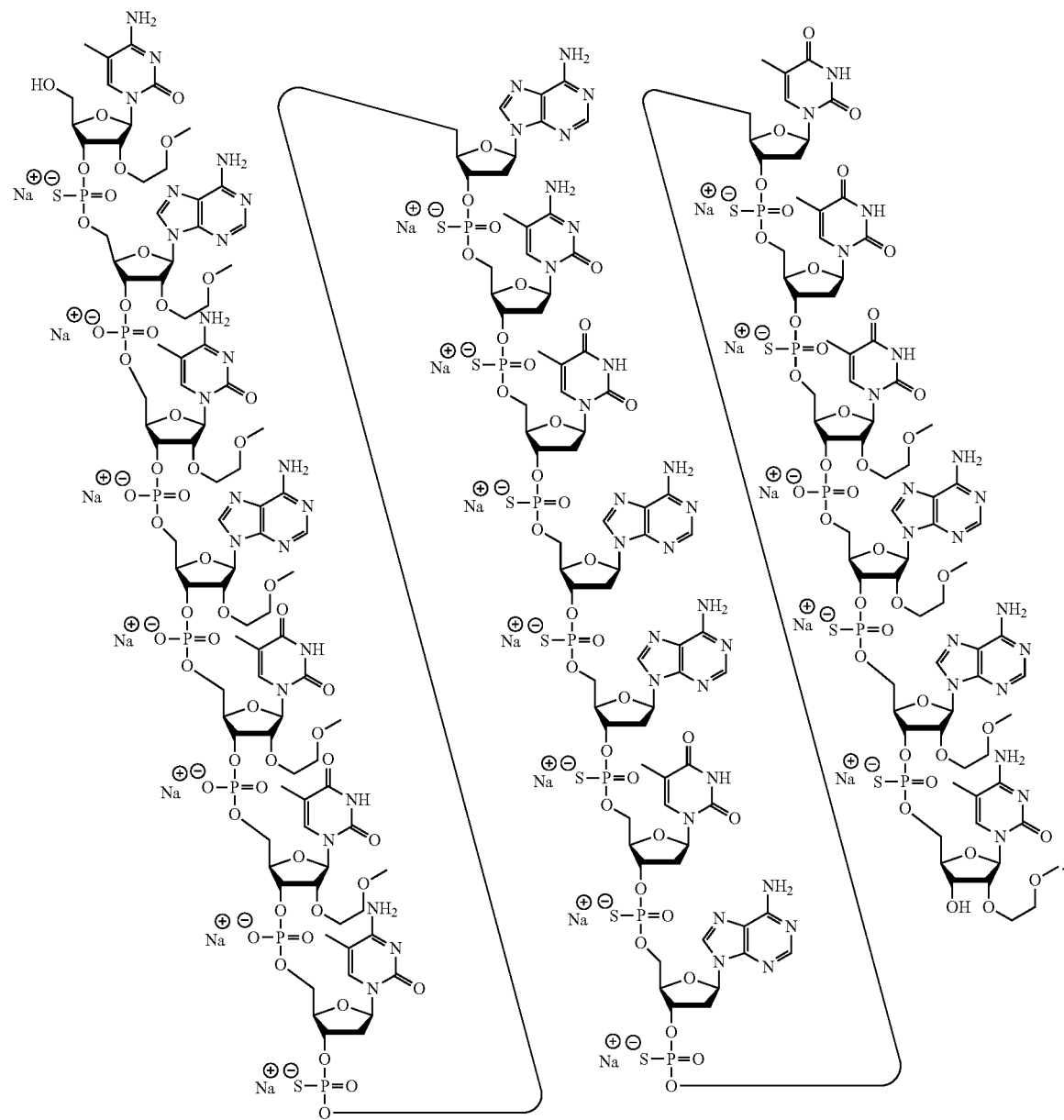

Embodiment 48: A modified oligonucleotide according to the following chemical structure:
(SEQ ID NO: 825)
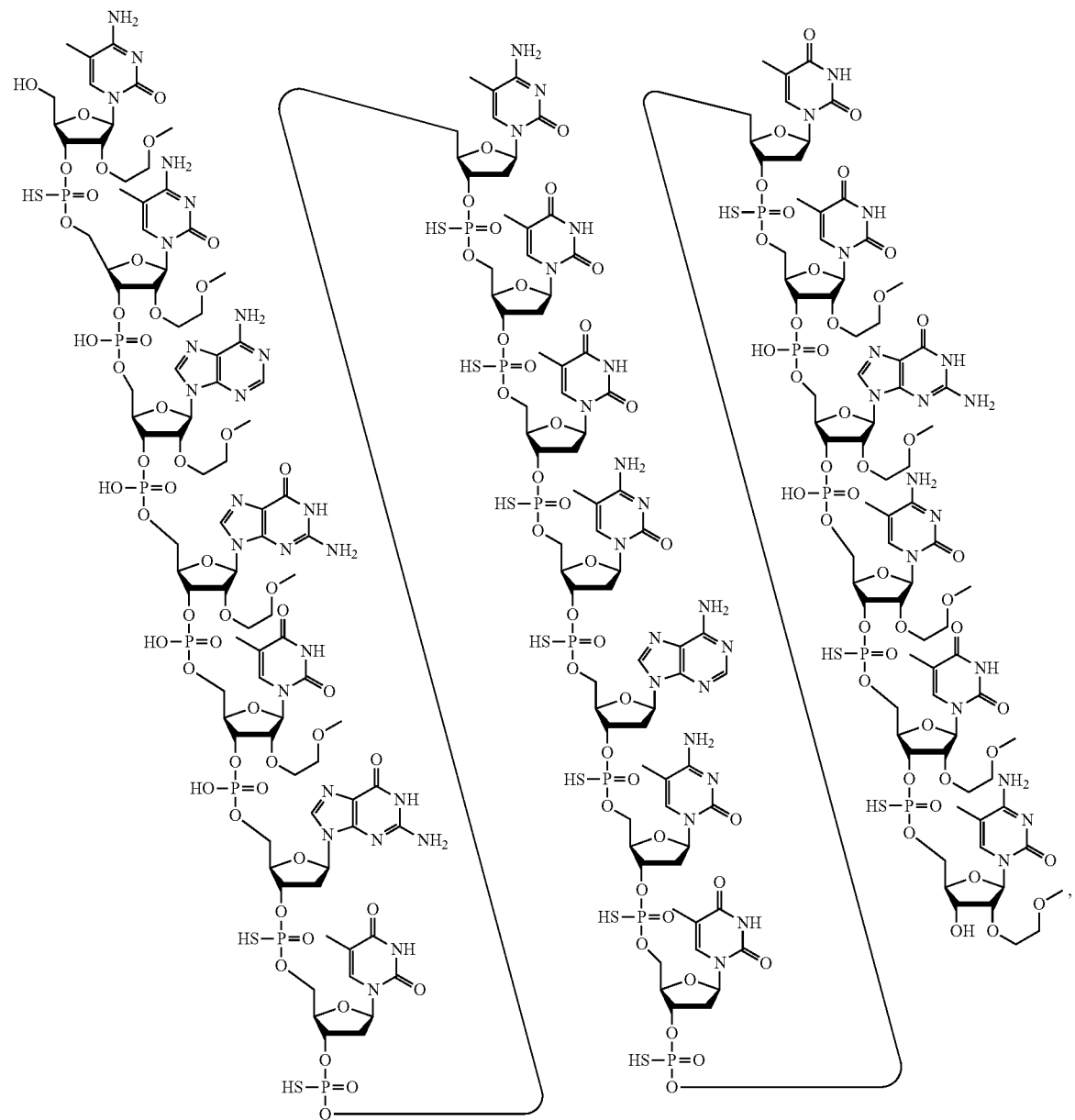
or a salt thereof.

Embodiment 49: A modified oligonucleotide according to the following chemical structure:
(SEQ ID NO: 825)
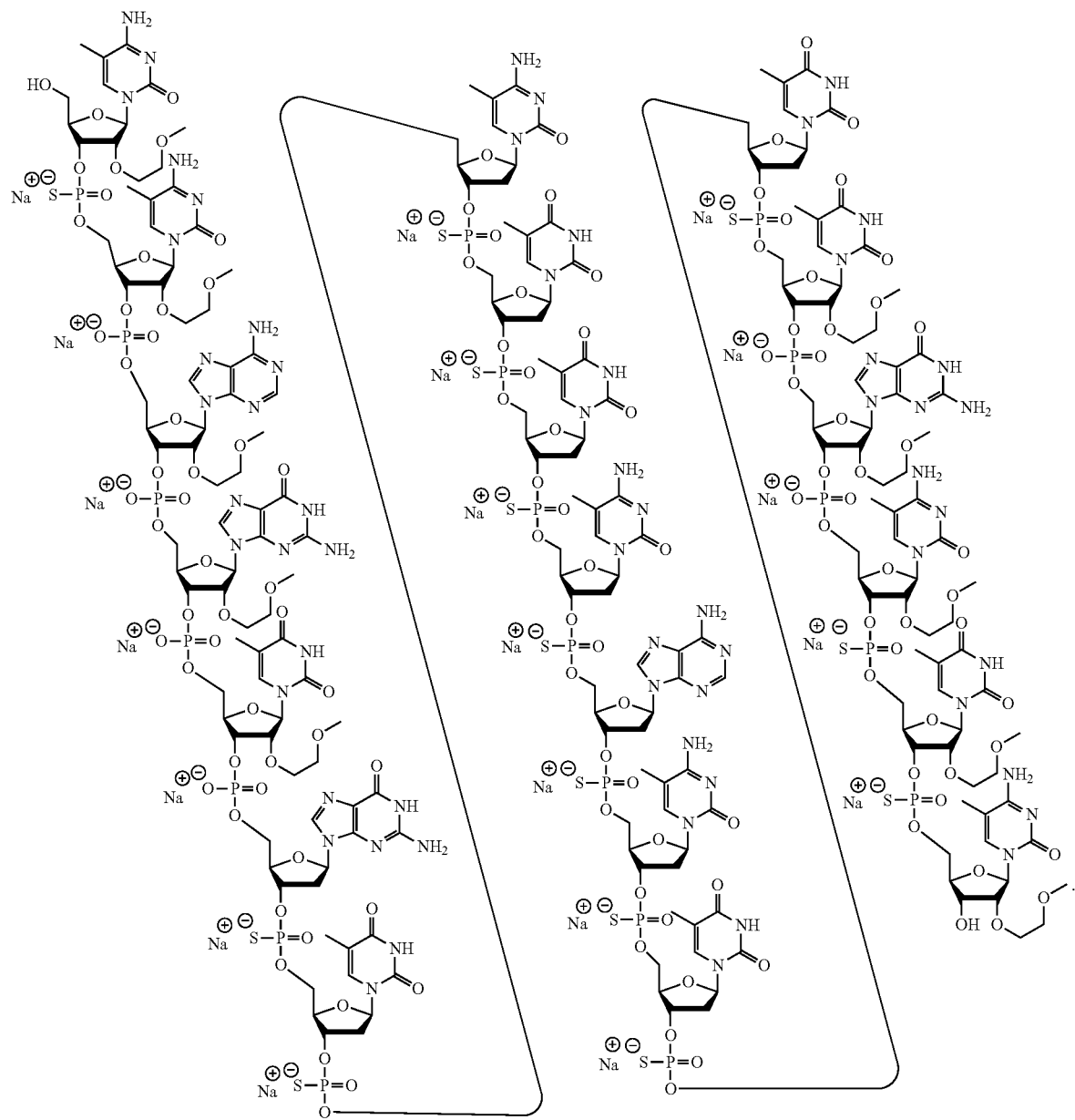

Embodiment 50: A modified oligonucleotide according to the following chemical structure:
(SEQ ID NO: 1499)
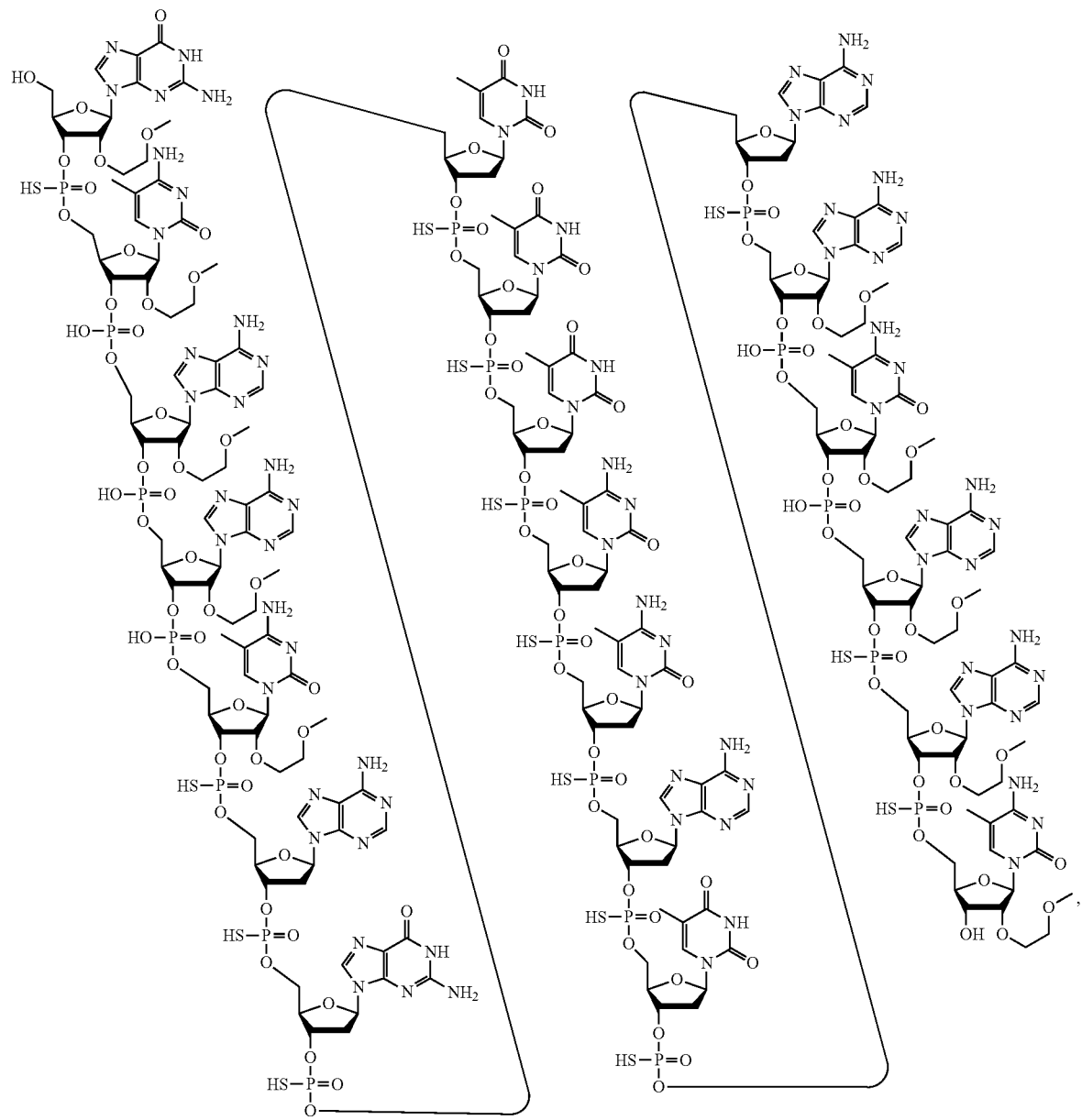
or a salt thereof.

Embodiment 51: A modified oligonucleotide according to the following chemical structure:
(SEQ ID NO: 1499)
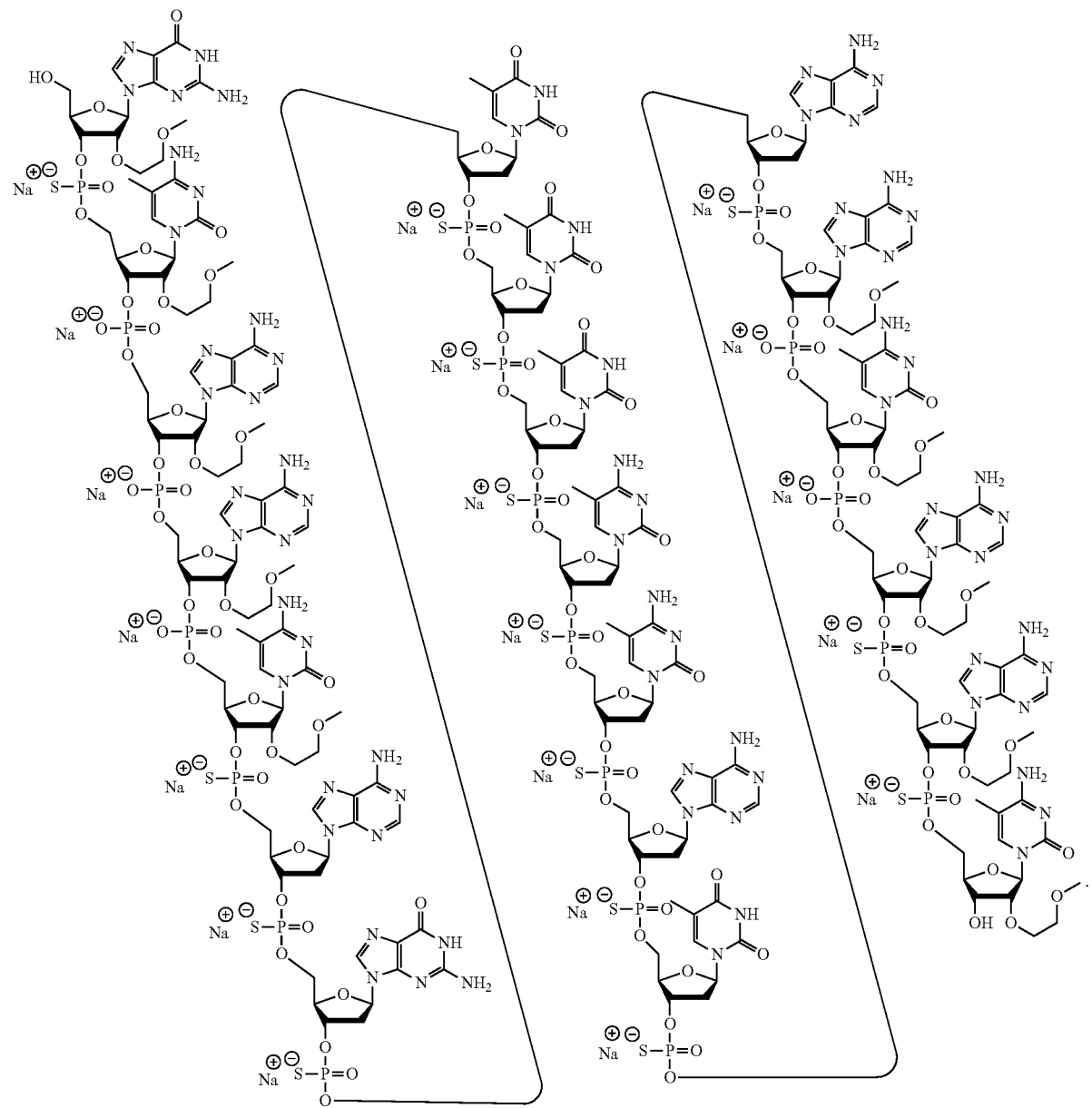

Embodiment 52: A modified oligonucleotide according to the following chemical structure:
(SEQ ID NO: 2170)
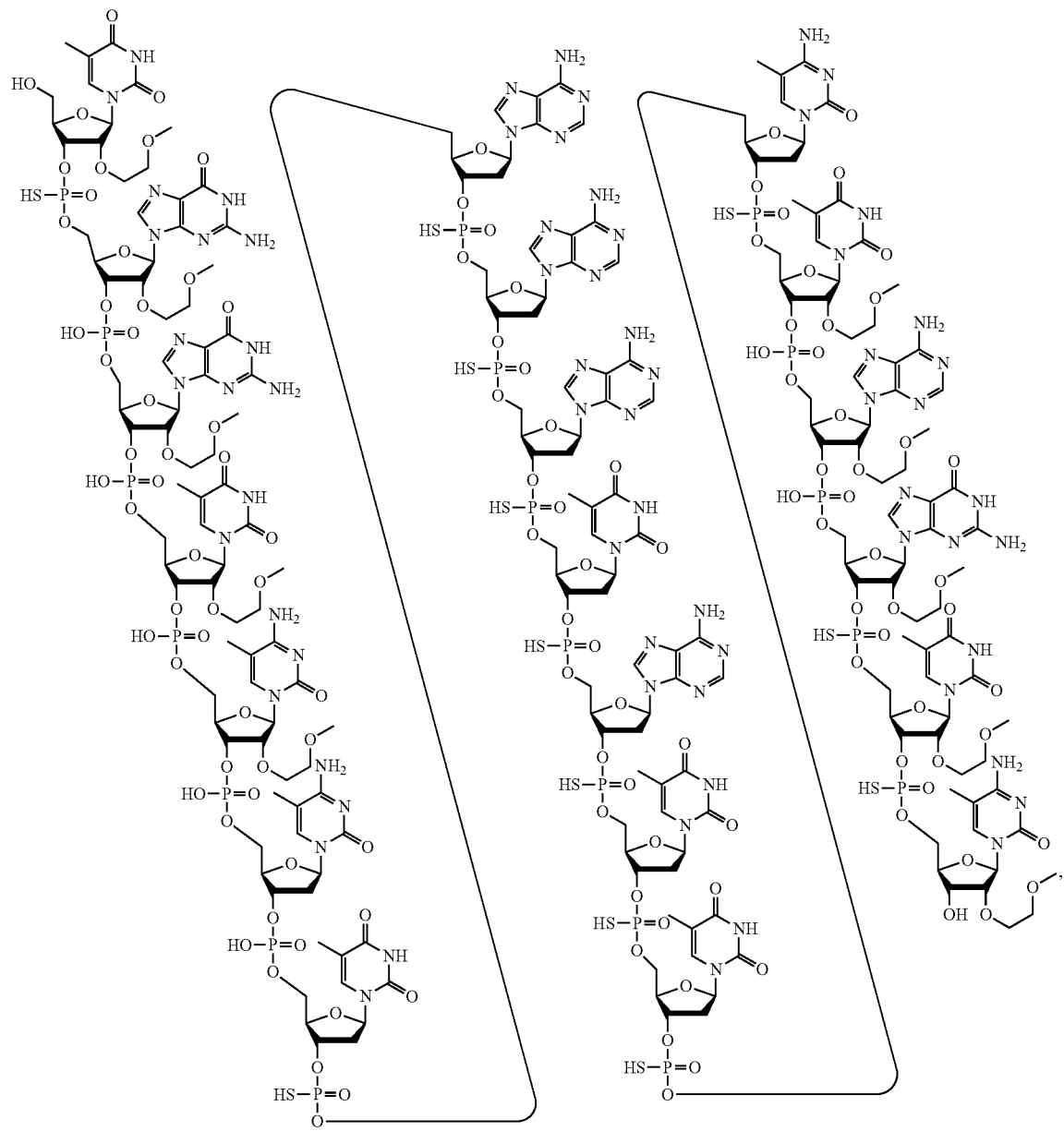
or a salt thereof.

Embodiment 53: A modified oligonucleotide according to the following chemical structure:
(SEQ ID NO: 2170)
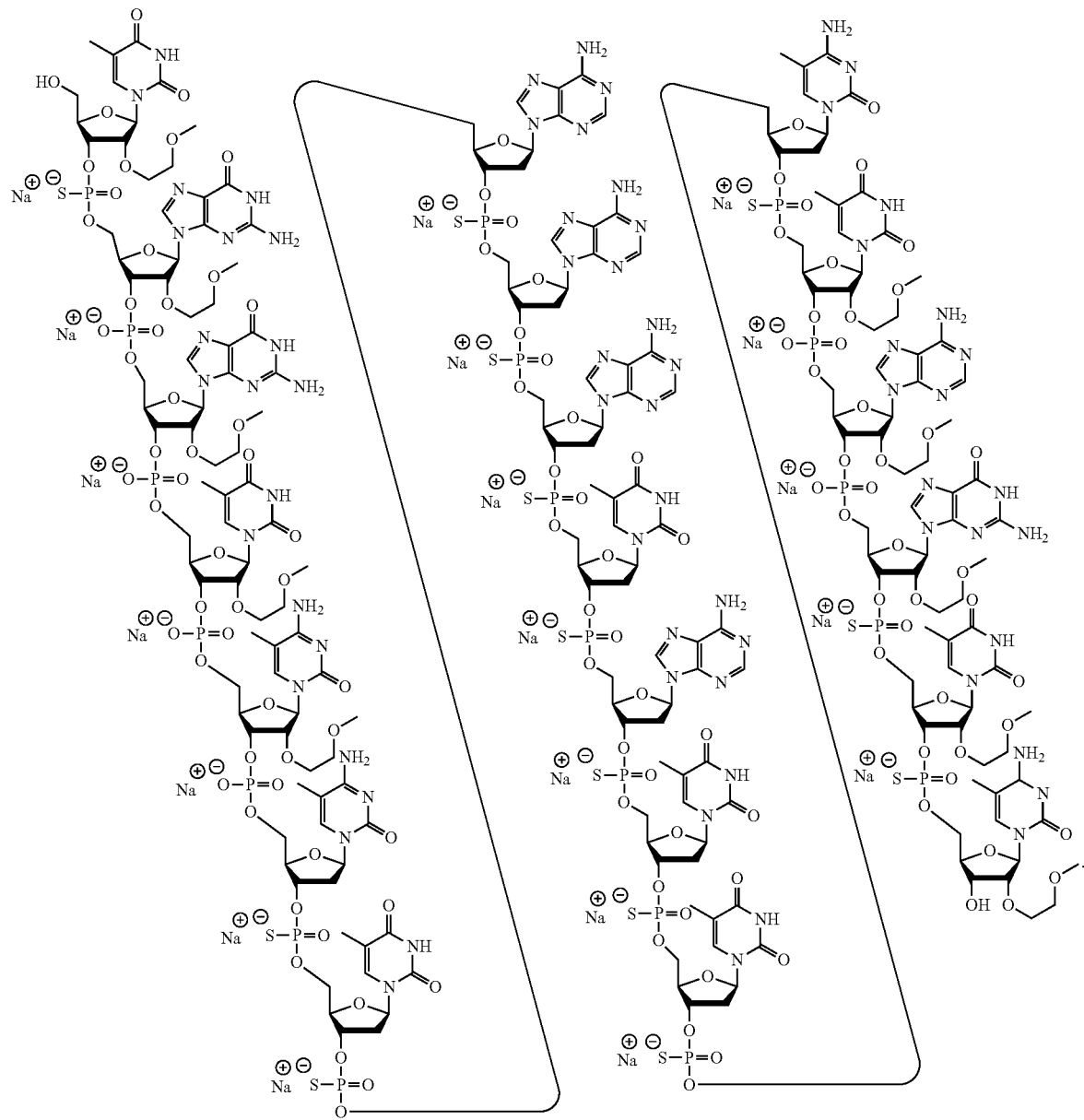

Embodiment 54: A modified oligonucleotide according to the following chemical structure:
(SEQ ID NO: 2818)
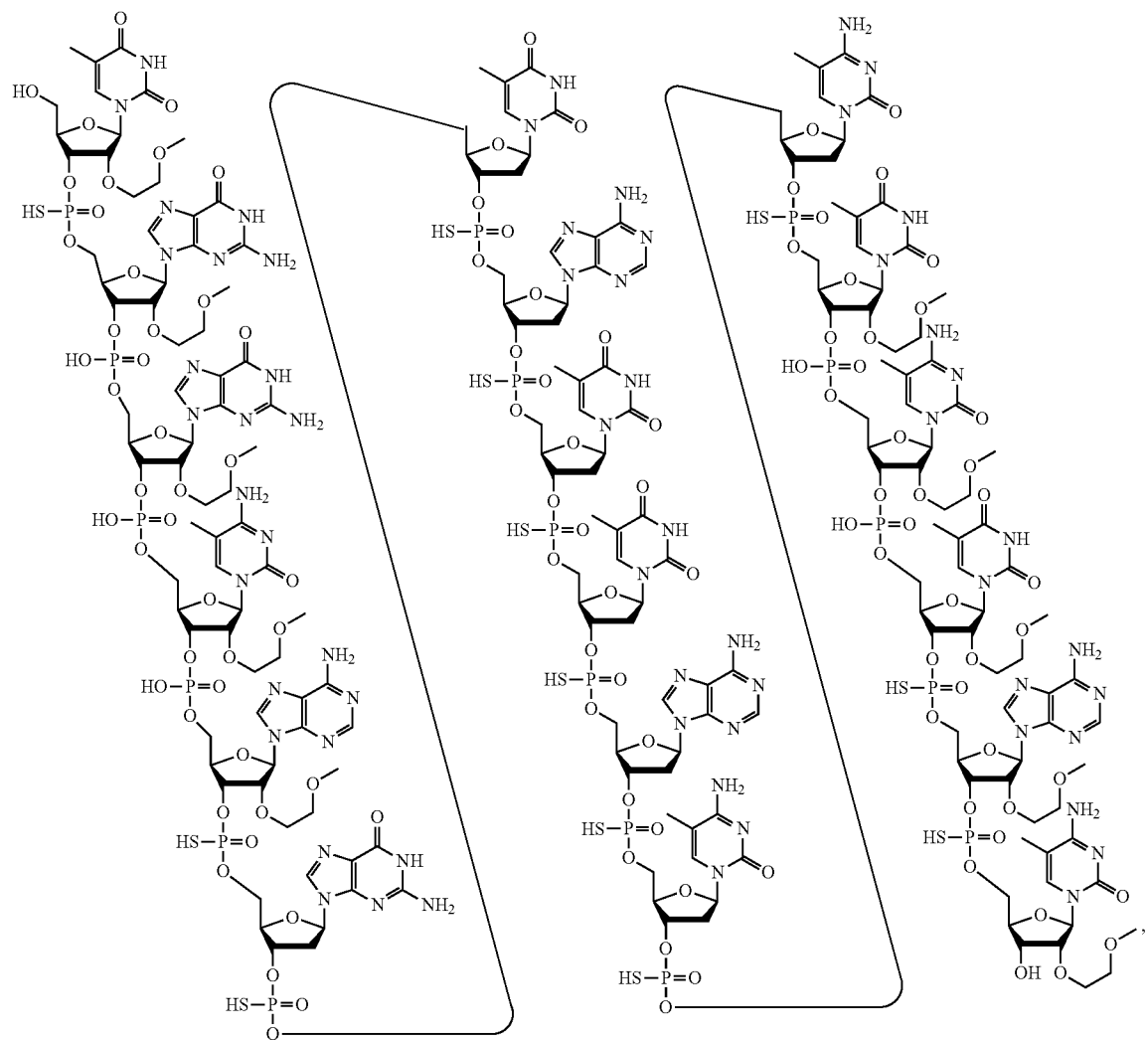
or a salt thereof.

Embodiment 55: A modified oligonucleotide according to the following chemical structure:

(SEQ ID NO: 2818)

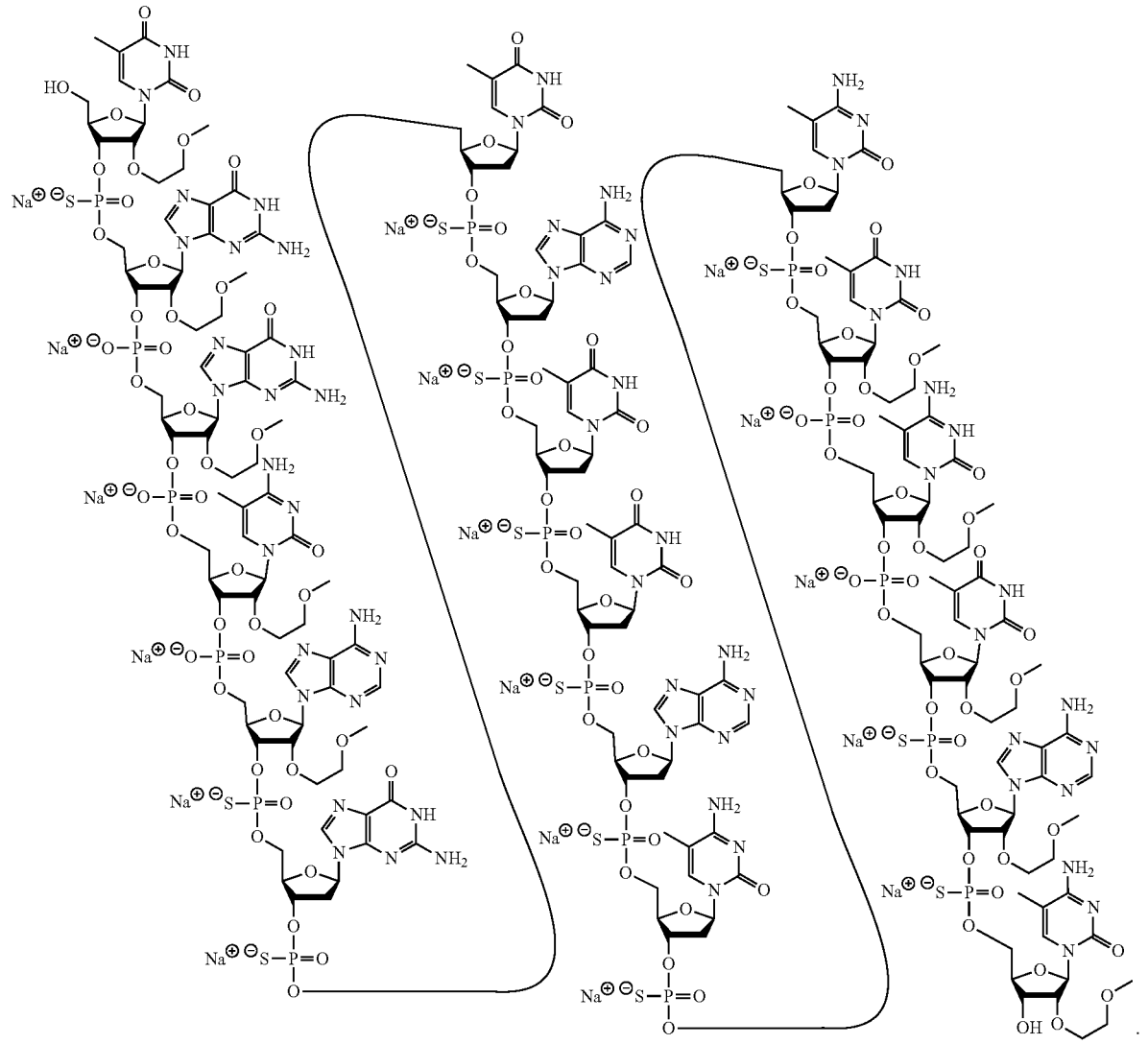

Embodiment 56: The modified oligonucleotide of any one of embodiments 44, 46, 48, 50, 52, and 54, which is the sodium salt or potassium salt of the chemical structure.

Embodiment 57: A pharmaceutical composition comprising the modified oligonucleotide of any of embodiments 44-56 and a pharmaceutically acceptable carrier or diluent.

Embodiment 58: The pharmaceutical composition of embodiment 57, wherein the pharmaceutically acceptable diluent is artificial cerebrospinal fluid.

Embodiment 59: The pharmaceutical composition of embodiment 58, wherein the pharmaceutical composition consists of the modified oligonucleotide and artificial cerebrospinal fluid.

Embodiment 60: A compound comprising a modified oligonucleotide according to the following chemical notation: $^{m}C_{es}A_{eo}G_{eo}T_{eo}A_{eo}T_{eo}T_{ds}A_{ds}{}^{m}C_{as}{}^{m}C_{as}T_{ds}{}^{m}C_{as}T_{ds}A_{ds}{}^{m}C_{as}T_{ds}A_{eo}G_{es}T_{es}{}^{m}C_{e}$ (SEQ ID NO: 20), wherein:

A=an adenine nucleobase,
$^{m}C$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

Embodiment 61: A compound comprising a modified oligonucleotide according to the following chemical notation: $^{m}C_{es}A_{eo}{}^{m}C_{eo}A_{eo}T_{eo}T_{eo}{}^{m}C_{ds}A_{ds}{}^{m}C_{ds}T_{ds}A_{ds}A_{ds}T_{ds}A_{ds}T_{ds}T_{ds}T_{eo}A_{es}A_{es}{}^{m}C_{e}$ (SEQ ID NO: 21), wherein:

A=an adenine nucleobase,
$^{m}C$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and o=a phosphodiester internucleoside linkage.

Embodiment 62: A compound comprising a modified oligonucleotide according to the following chemical notation: $^mC_{es}{}^mC_{eo}A_{eo}G_{eo}T_{eo}G_{ds}T_{ds}{}^mC_{ds}T_{ds}T_{ds}{}^mC_{ds}A_{ds}{}^mC_{ds}T_{ds}T_{ds}T_{eo}G_{eo}{}^mC_{es}T_{es}{}^mC_e$ (SEQ ID NO: 825), wherein:
A=an adenine nucleobase,
$^mC$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

Embodiment 63: A compound comprising a modified oligonucleotide according to the following chemical notation: $G_{es}{}^mC_{eo}A_{eo}A_{eo}{}^mC_{es}A_{ds}G_{ds}T_{ds}T_{ds}T_{ds}{}^mC_{ds}{}^mC_{ds}A_{ds}T_{ds}A_{ds}A_{eo}{}^mC_{eo}A_{es}A_{es}{}^mC_e$ (SEQ ID NO: 1499), wherein:
A=an adenine nucleobase,
$^mC$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

Embodiment 64: A compound comprising a modified oligonucleotide according to the following chemical notation: $T_{es}G_{eo}G_{eo}T_{eo}{}^mC_{eo}{}^mC_{ds}T_{ds}A_{ds}A_{ds}A_{ds}T_{ds}A_{ds}T_{ds}T_{ds}{}^mC_{ds}T_{eo}A_{eo}G_{es}T_{es}{}^mC_e$ (SEQ ID NO: 2170), wherein:
A=an adenine nucleobase,
$^mC$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

Embodiment 65: A compound comprising a modified oligonucleotide according to the following chemical notation: $T_{es}G_{eo}G_{eo}{}^mC_{eo}A_{es}G_{ds}T_{ds}A_{ds}T_{ds}T_{ds}A_{ds}{}^mC_{ds}{}^mC_{ds}T_{eo}{}^mC_{eo}T_{es}A_{es}{}^mC_e$ (SEQ ID NO: 2818), wherein:
A=an adenine nucleobase,
$^mC$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

Embodiment 66: The compound of any of embodiments 60-65, comprising the modified oligonucleotide covalently linked to a conjugate group.

Embodiment 67: A pharmaceutical composition comprising a compound of any of embodiments 60-66, and a pharmaceutically acceptable diluent or carrier.

Embodiment 68: The pharmaceutical composition of embodiment 67, wherein the pharmaceutically acceptable diluent is artificial cerebrospinal fluid.

Embodiment 69: The pharmaceutical composition of embodiment 68, wherein the pharmaceutical composition consists of the compound and artificial cerebrospinal fluid.

Embodiment 70: A chirally enriched population of modified oligonucleotides of any of embodiments 60-65, wherein the population is enriched for modified oligonucleotides comprising at least one particular phosphorothioate internucleoside linkage having a particular stereochemical configuration.

Embodiment 71: The chirally enriched population of embodiment 70, wherein the population is enriched for modified oligonucleotides comprising at least one particular phosphorothioate internucleoside linkage having the (Sp) configuration.

Embodiment 72: The chirally enriched population of embodiment 70, wherein the population is enriched for modified oligonucleotides comprising at least one particular phosphorothioate internucleoside linkage having the (Rp) configuration.

Embodiment 73: The chirally enriched population of embodiment 70, wherein the population is enriched for modified oligonucleotides having a particular, independently selected stereochemical configuration at each phosphorothioate internucleoside linkage Embodiment 74: The chirally enriched population of embodiment 70, wherein the population is enriched for modified oligonucleotides having the (Sp) configuration at each phosphorothioate internucleoside linkage.

Embodiment 75: The chirally enriched population of embodiment 70, wherein the population is enriched for modified oligonucleotides having the (Rp) configuration at each phosphorothioate internucleoside linkage.

Embodiment 76: The chirally enriched population of embodiment 70, wherein the population is enriched for modified oligonucleotides having the (Rp) configuration at one particular phosphorothioate internucleoside linkage and the (Sp) configuration at each of the remaining phosphorothioate internucleoside linkages.

Embodiment 77: The chirally enriched population of embodiment 70 or embodiment 73 wherein the population is enriched for modified oligonucleotides having at least 3 contiguous phosphorothioate internucleoside linkages in the Sp, Sp, and Rp configurations, in the 5' to 3' direction.

Embodiment 78: A chirally enriched population of modified oligonucleotides of any of embodiments 44-55, wherein all of the phosphorothioate internucleoside linkages of the modified oligonucleotide are stereorandom.

Embodiment 79: A method comprising administering to an individual the pharmaceutical composition of any of embodiments 56-58 and 67-69.

Embodiment 80: A method of treating a disease associated with GFAP, comprising administering to an individual having or at risk of having a disease associated with GFAP a therapeutically effective amount of the pharmaceutical composition of any one of embodiments 56-58 and 67-69, thereby treating the disease associated with GFAP.

Embodiment 81: A method of reducing GFAP protein in the CSF of an individual having or at risk of having a disease associated with GFAP a therapeutically effective amount of a pharmaceutical composition of any one of embodiments 56-58 and 67-69, thereby reducing GFAP protein in the CSF.

Embodiment 82: The method of embodiment 80 or embodiment 81, wherein the disease is a neurodegenerative disease.

Embodiment 83: The method of any of embodiments 80-82, wherein the disease is Alexander disease.

Embodiment 84: The method of any of embodiments 80-83, wherein at least one symptom or hallmark of the disease is ameliorated.

Embodiment 85: The method of embodiment 84, wherein the symptom or hallmark is any of motor delays, cognitive delays, paroxysmal deterioration, seizures, vomiting, swallowing difficulties, ataxic gait, palatal myoclonus, autonomic dysfunction, or the presence of intra-astrocytic inclusions called Rosenthal fibers.

Embodiment 86: The method of any of embodiments 79-85, wherein the pharmaceutical composition is administered to the central nervous system or systemically.

Embodiment 87: The method of embodiment 86, wherein the pharmaceutical composition is administered to the central nervous system and systemically.

Embodiment 88: The method of any of embodiments 80-87, wherein the pharmaceutical composition is administered any of intrathecally, systemically, subcutaneously, or intramuscularly.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE" or "O-methoxyethyl"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O-C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

In certain embodiments, modified furanosyl sugar moieties and nucleosides incorporating such modified furanosyl sugar moieties are further defined by isomeric configuration. For example, a 2'-deoxyfuranosyl sugar moiety may be in seven isomeric configurations other than the naturally occurring β-D-deoxyribosyl configuration. Such modified sugar moieties are described in, e.g., WO 2019/157531, incorporated by reference herein. A 2'-modified sugar moiety has an additional stereocenter at the 2'-position relative to a 2'-deoxyfuranosyl sugar moiety; therefore, such sugar moieties have a total of sixteen possible isomeric configurations. 2'-modified sugar moieties described herein are in the β-D-ribosyl isomeric configuration unless otherwise specified.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2' 4'-(CH$_2$)$_2$-2' 4'-(CH$_2$)$_3$-2' 4'-CH$_2$—O-2' ("LNA"), 4'-CH$_2$—S-2' 4'-CH$_2$)$_2$—O-2' ("ENA"), 4'-CH(CH$_3$)—O-2' (referred to as "constrained ethyl" or "cEt"), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., *J. Org. Chem.*, 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2' and 4'-CH$_2$—N(R)—O-2' wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Wengel et al., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

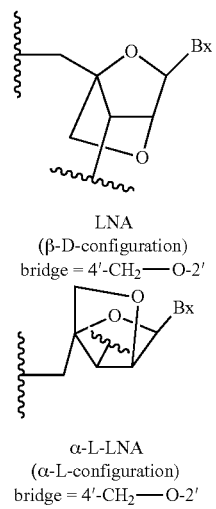

LNA
(β-D-configuration)
bridge = 4'-CH$_2$—O-2'

α-L-LNA
(α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2' position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. &Med. Chem.* 2002, 10, 841-854), fluoro HNA:

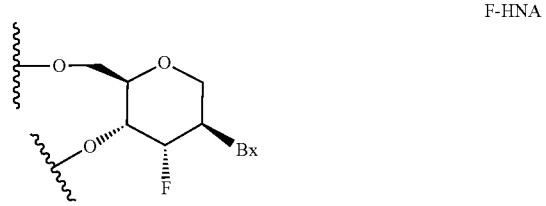

F-HNA ("F-HNA", see e.g. Swayze et al., U.S. Pat. No. 8,088,904; Swayze et al., U.S. Pat. No. 8,440,803; Swayze et al., U.S.

Pat. No. 8,796,437; and Swayze et al., U.S. Pat. No. 9,005,906; F-HNA can also be referred to as a F-THP or 3☐ fluoro tetrahydropyran), and nucleosides comprising additional modified THP compounds having the formula:

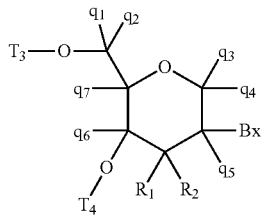

wherein, independently, for each of the modified THP nucleosides:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5☐ or 3☐ terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and gp are each H. In certain embodiments, at least one of $q_1$, $q_2$, $q_3$, $q_4$, $q_5$, $q_6$ and gp is other than H. In certain embodiments, at least one of $q_1$, $q_2$, $q_3$, $q_4$, $q_5$, $q_6$ and gp is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

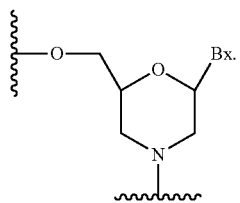

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH₃) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257;

Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("P(O$_2$)=O") (also referred to as unmodified or naturally occurring linkages), phosphotriesters, methylphosphonates, phosphoramidates, phosphorothioates ("P(O$_2$)=S"), and phosphorodithioates ("HS-P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N⊖ dimethylhydrazine (—CH$_2$—N(CH$_3$)—N(CH$_3$)—). Modified internucleoside linkages, compared to naturally occurring phosphodiester internucleoside linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate internucleoside linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate internucleoside linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkage in a particular, independently selected stereochemical configuration. In certain embodiments, the particular configuration of the particular phosphorothioate internucleoside linkage is present in at least 65% of the molecules in the population. In certain embodiments, the particular configuration of the particular phosphorothioate internucleoside linkage is present in at least 70% of the molecules in the population. In certain embodiments, the particular configuration of the particular phosphorothioate internucleoside linkage is present in at least 80% of the molecules in the population. In certain embodiments, the particular configuration of the particular phosphorothioate internucleoside linkage is present in at least 90% of the molecules in the population. In certain embodiments, the particular configuration of the particular phosphorothioate internucleoside linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

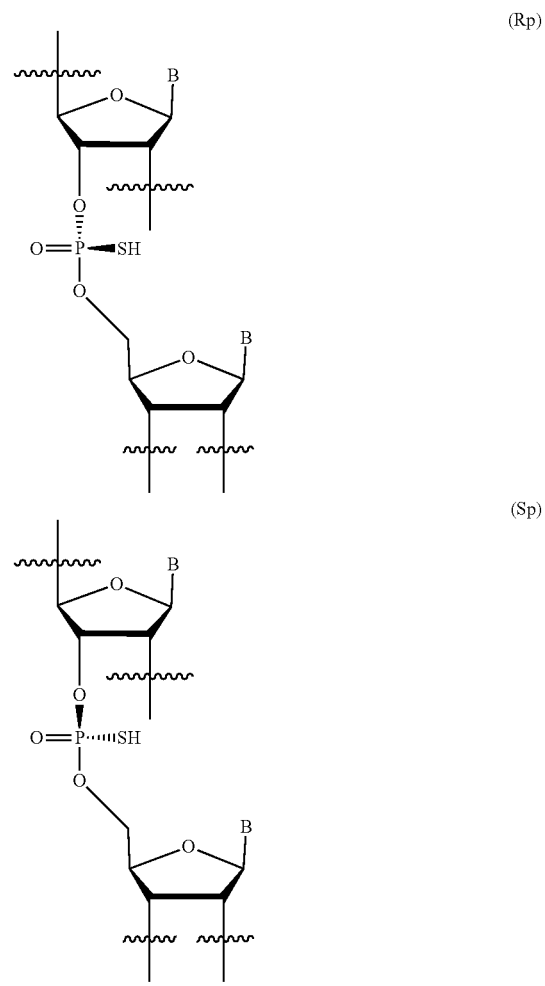

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3′—CH₂—N(CH₃)—O-5′), amide-3 (3′—CH₂—C(=O)—N(H)-5′), amide-4 (3′—CH₂—N(H)—C(=O)-5′), formacetal (3′—O—CH₂—O-5′), methoxypropyl (MOP), and thioformacetal (3′—S—CH₂—O-5′). Further neutral internucleoside linkages include nonionic linkages comprising siloxane (dialkylsiloxane), carboxylate ester, carboxamide, sulfide, sulfonate ester and amides (see for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH₂ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5′-wing, the gap, and the 3′-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3′-most nucleoside of the 5′-wing and the 5′-most nucleoside of the 3′-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5′ wing differs from the sugar motif of the 3′ wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2′-deoxyribosyl sugar moiety. In certain embodiments, each nucleoside of the gap of a gapmer comprises a 2′-β-D-deoxyribosyl sugar moiety. In certain embodiments, at least one nucleoside of the gap of a gapmer comprises a modified sugar moiety. In certain embodiments, at least one nucleoside of the gap of a gapmer comprises a 2′-OMe sugar moiety.

In certain embodiments, the gapmer is a deoxy gapmer. In certain embodiments, the nucleosides on the gap side of each wing/gap junction comprise 2′-deoxyribosyl sugar moieties and the nucleosides on the wing sides of each wing/gap junction comprise modified sugar moieties. In certain embodiments, each nucleoside of the gap comprises a 2-deoxyribosyl sugar moiety. In certain embodiments, each nucleoside of each wing of a gapmer comprises a modified sugar moiety. In certain embodiments, one nucleoside of the gap comprises a modified sugar moiety and each remaining nucleoside of the gap comprises a 2-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2′-modification.

Herein, the lengths (number of nucleosides) of the three regions of a gapmer may be provided using the notation [# of nucleosides in the 5′-wing]–[# of nucleosides in the gap]–[# of nucleosides in the 3′-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprises a 2′-β-D-deoxyribosyl sugar moiety. Thus, a 5-10-5 MOE gapmer consists of 5 linked 2′-MOE nucleosides in the 5′-wing, 10 linked 2′-β-D-deoxynucleosides in the gap, and 5 linked 2′-MOE nucleosides in the 3′-wing. A 3-10-3 cEt gapmer consists of 3 linked cEt nucleosides in the 5′-wing, 10 linked 2′-β-D-deoxynucleosides in the gap, and 3 linked cEt nucleosides in the 3′-wing. A 5-8-5 gapmer consists of 5 linked nucleosides comprising a modified sugar moiety in the 5′-wing, 8 linked 2′-deoxynucleosides in the gap, and 5 linked nucleosides comprising a modified sugar moiety in the 3′-wing. A mixed wing gapmer has at least two different modified sugars in the 5′ and/or 3′ wing. A 5-8-5 or 5-8-4 mixed wing gapmer has at least two different modified sugar moieties in the 5′- and/or the 3′-wing.

In certain embodiments, modified oligonucleotides are 5-10-5 MOE gapmers. In certain embodiments, modified oligonucleotides are 4-10-6 MOE gapmers. In certain embodiments, modified oligonucleotides are 6-10-4 MOE gapmers. In certain embodiments, modified oligonucleotides are 5-8-5 MOE gapmers. In certain embodiments, modified oligonucleotides are X-Y-Z MOE gapmers, wherein X and Z are independently selected from 1, 2, 3, 4, 5, or 6 and Y is 7, 8, 9, 10, or 11.

In certain embodiments, modified oligonucleotides have the following sugar motif (5' to 3'): meeeemddddddddddmmmmm, wherein 'd' represents a 2'-deoxyribosyl sugar moiety, 'e' represents a 2'-MOE sugar moiety, and 'm' represents a 2'-OMe sugar moiety.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines. In certain embodiments, all of the cytosine nucleobases are 5-methylcytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of the nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester internucleoside linkage is not a terminal internucleoside linkage, and the remaining internucleoside linkages are phosphorothioate internucleoside linkages. In certain such embodiments, all of the phosphorothioate internucleoside linkages are stereorandom. In certain embodiments, all of the phosphorothioate internucleoside linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified oligonucleotides have an internucleoside linkage motif of sooosssssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'): sooooosssssssssssoss, wherein each "s" represents a phosphorothioate internucleoside linkage and each "o" represents a phosphodiester internucleoside linkage. In certain embodiments, modified oligonucleotides have an internucleoside linkage motif of (5' to 3'): soooosssssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'):sooosssssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'): sooosssssssssssoooss, wherein each "s" represents a phosphorothioate internucleoside linkage and each "o" represents a phosphodiester internucleoside linkage. In certain embodiments, modified oligonucleotides have an internucleoside linkage motif of (5' to 3'): sooossssssssssssssss, wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al. Proc. Natl. Acad. Sci. USA 89:7305-7309, 1992) a series of oligonucleotides 13-25 nucleobases in length were tested for their ability to induce cleavage of a target nucleic acid in an oocyte injection model. Oligonucleotides 25 nucleobases in length with 8 or 11 mismatch bases near the ends of the oligonucleotides were able to direct specific cleavage of the target nucleic acid, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X<Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2 position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, abasic nucleosides, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., *Proc. Natl. Acad. Sci. USA*, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330;

Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; and Nishina et al., *Molecular Therapy,* 2008, 16, 734-740), or a GalNAc cluster (e.g., WO2014/179620).

In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, lipophilic groups, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester internucleoside linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2□ deoxynucleoside that is attached to either the 3□ or 5□ terminal nucleoside of an oligonucleotide by a phosphodiester internucleoside linkage and covalently attached to the remainder of the conjugate linker or conjugate moiety by a phosphate or phosphorothioate internucleoside linkage.

In certain such embodiments, the cleavable moiety is 2□ deoxyadenosine.

3. Cell-Targeting Moieties

In certain embodiments, a conjugate group comprises a cell-targeting moiety. In certain embodiments, a conjugate group has the general formula:

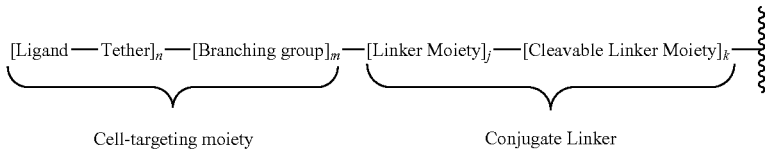

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target nucleic acid is a mature mRNA. In certain embodiments, the target nucleic acid is a pre-mRNA. In certain embodiments, the target region is entirely within an intron. In certain embodiments, the target region spans an intron/exon junction. In certain embodiments, the target region is at least 50% within an intron.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28- and 42-nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, 8, 9, 10, or 11 from the 5'-end of the gap region. In certain embodiments, the mismatch is at position 1, 2, 3, 4, 5, or 6 from the 5'-end of the 5' wing region or the 3' wing region.

B. GFAP

In certain embodiments, oligomeric compounds comprise or consist of an oligonucleotide that is complementary to a target nucleic acid, wherein the target nucleic acid is a GFAP nucleic acid. In certain embodiments, GFAP nucleic acid has the sequence set forth in SEQ ID NO: 1 (GENBANK Accession No. NM_002055.4), SEQ ID NO: 2 (GENBANK Accession No. NC_000017.11 truncated from nucleotides 44903001 to 44919000), or SEQ ID NO: 3 (GENBANK Accession No. NM_001131019.2).

In certain embodiments, contacting a cell with an oligomeric compound complementary to any of SEQ ID NO: 1-3 reduces the amount of GFAP RNA and in certain embodiments reduces the amount of GFAP protein. In certain embodiments, the oligomeric compound consists of a modified oligonucleotide. In certain embodiments, contacting a cell with an oligomeric compound complementary to any of SEQ ID NO: 1-3 reduces the amount of GFAP RNA in a cell, and in certain embodiments reduces the amount of GFAP protein in a cell. In certain embodiments, the cell is in vitro. In certain embodiments, the cell is in a subject. In certain embodiments, the oligomeric compound consists of a modified oligonucleotide. In certain embodiments, contacting a cell in a subject with an oligomeric compound complementary to any of SEQ ID NO: 1-3 ameliorates one or more symptom or hallmark of a leukodystrophy. In certain embodiments, the leukodystrophy is AxD. In certain embodiments, the symptom or hallmark is selected from motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers.

In certain embodiments, an oligomeric compound complementary to any of SEQ ID NO: 1-3 is capable of reducing the detectable amount of GFAP RNA in vitro by at least 10%, at least 20%, at least 30%, at least 40%, at least 50%, at least 60%, at least 70%, at least 80%, or at least 90% when administered according to the standard cell assay. In certain embodiments, an oligomeric compound complementary to SEQ ID NO: 1, SEQ ID NO: 2915, or SEQ ID NO: 2916 is capable of decreasing the amount of GFAP in vitro by at least 10%, at least 20%, at least 30%, at least 40%, at least 50%, at least 60%, at least 70%, at least 80%, or at least 90% when administered according to the standard in vitro assay. In certain embodiments, an oligomeric compound complementary to SEQ ID NO: 1, SEQ ID NO: 2, or SEQ ID NO: 3 is capable of reducing the detectable amount of GFAP RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2, or SEQ ID NO: 3 is capable of decreasing the detectable amount of GFAP in the CSF of a subject by at least 10%, at least 20%, at least 30%, at least 40%, at least 50%, at least 60%, at least 70%, at least 80%, or at least 90%.

C. Certain Target Nucleic Acids in Certain Tissues

In certain embodiments, oligomeric compounds comprise or consist of an oligonucleotide comprising a portion that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include the brain and spinal cord. In certain embodiments, the pharmacologically relevant tissues include white matter tracts across the brain and spinal cord, such tissues include the corpus callosum, cortex, cerebellum, hippocampus, brain stem, striatum, and spinal cord. In certain embodiments, the pharmacologically relevant tissues include the cortex, cerebellum, hippocampus, brain stem, and spinal cord. In certain embodiments, the pharmacologically relevant cells are oligodendrocytes and oligodendrocyte progenitor cells. In certain embodiments, the pharmacologically relevant cells are Schwann cells or Schwann cell progenitors.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid ("artificial CSF" or "aCSF"). In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents comprising an oligomeric compound provided herein to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), intraneural, perineural, etc.). In certain of such embodiments, a pharmaceutical composition comprises a carrier and is formulated in aqueous solution, such as water or physiologically compatible buffers such as Hanks ⓢ solution, Ringer ⓢ solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of Compound No. 1362458, equals the number of fully protonated molecules that weighs 10 mg. This would be equivalent to 10.47 mg of solvent-free, sodium acetate-free, anhydrous sodiated Compound No. 1362458. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

VI. Certain Compositions

1. Compound No. 1166998

In certain embodiments, Compound No. 1166998 is characterized as a 6-10-4 MOE gapmer having a sequence (from 5' to 3') of CAGTATTACCTCTACTAGTC (SEQ ID NO: 20), wherein each of nucleosides 1-6 and 17-20 (from 5' to 3') are 2'-β-D-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methylcytosine.

In certain embodiments, Compound No. 1166998 is represented by the following chemical notation: $^{m}C_{es}A_{eo}G_{eo}T_{eo}A_{eo}T_{eo}T_{ds}A_{ds}{}^{m}C_{ds}{}^{m}C_{ds}T_{ds}{}^{m}C_{ds}T_{ds}A_{ds}{}^{m}C_{ds}T_{ds}A_{eo}G_{es}T_{es}{}^{m}C_{e}$ (SEQ ID NO: 20), wherein:

A=an adenine nucleobase,
$^{m}$C=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1166998 is represented by the following chemical structure:
(SEQ ID NO: 20)
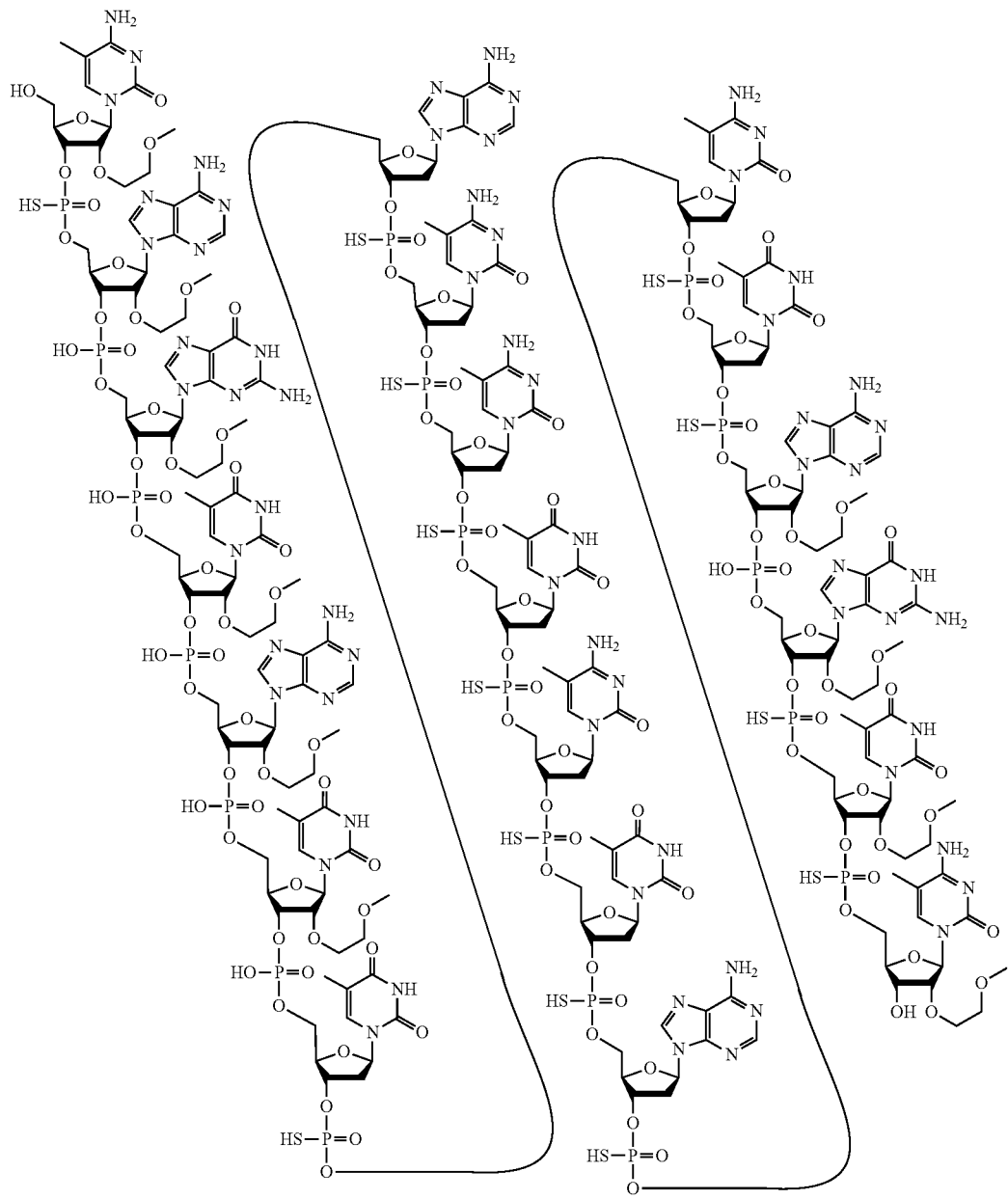

Structure 1. Compound No 116699

In certain embodiments, the sodium salt of Compound No. 1166998 is represented by the following chemical structure:

sides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methylcytosine.

(SEQ ID NO: 20)

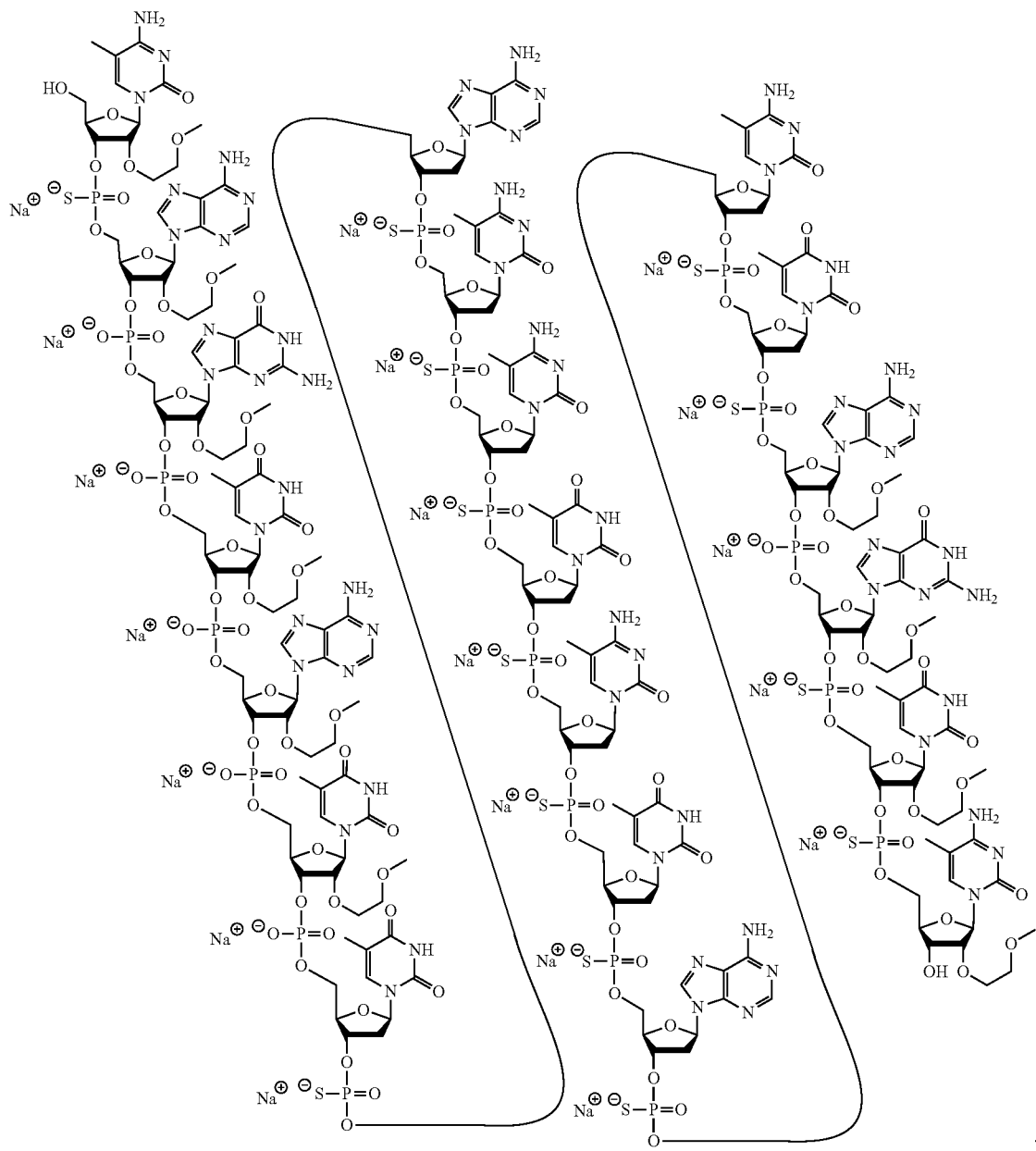

Structure 2. The Sodium Salt of Compound No. 1166998

2. Compound No. 1166985

In certain embodiments, Compound No. 1166985 is characterized as a 6-10-4 MOE gapmer having a sequence (from 5' to 3') of CACATTCACTAATATTTAAC (SEQ ID NO: 21), wherein each of nucleosides 1-6 and 17-20 (from 5' to 3') are 2'-β-D-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleo- In certain embodiments, Compound No. 1166985 is represented by the following chemical notation: $^{m}C_{es}A_{eo}{}^{m}$-$C_{eo}A_{eo}T_{eo}T_{eo}{}^{m}C_{ds}A_{ds}{}^{m}C_{ds}T_{ds}A_{ds}A_{ds}T_{ds}A_{ds}T_{ds}T_{ds}T_{eo}$ $A_{es}A_{es}{}^{m}C_{e}$ (SEQ ID NO: 21), wherein:

A=an adenine nucleobase, $^{m}$C=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and
o=a phosphodiester internucleoside linkage.
In certain embodiments, Compound No. 1166985 is represented by the following chemical structure:
(SEQ ID NO: 21)
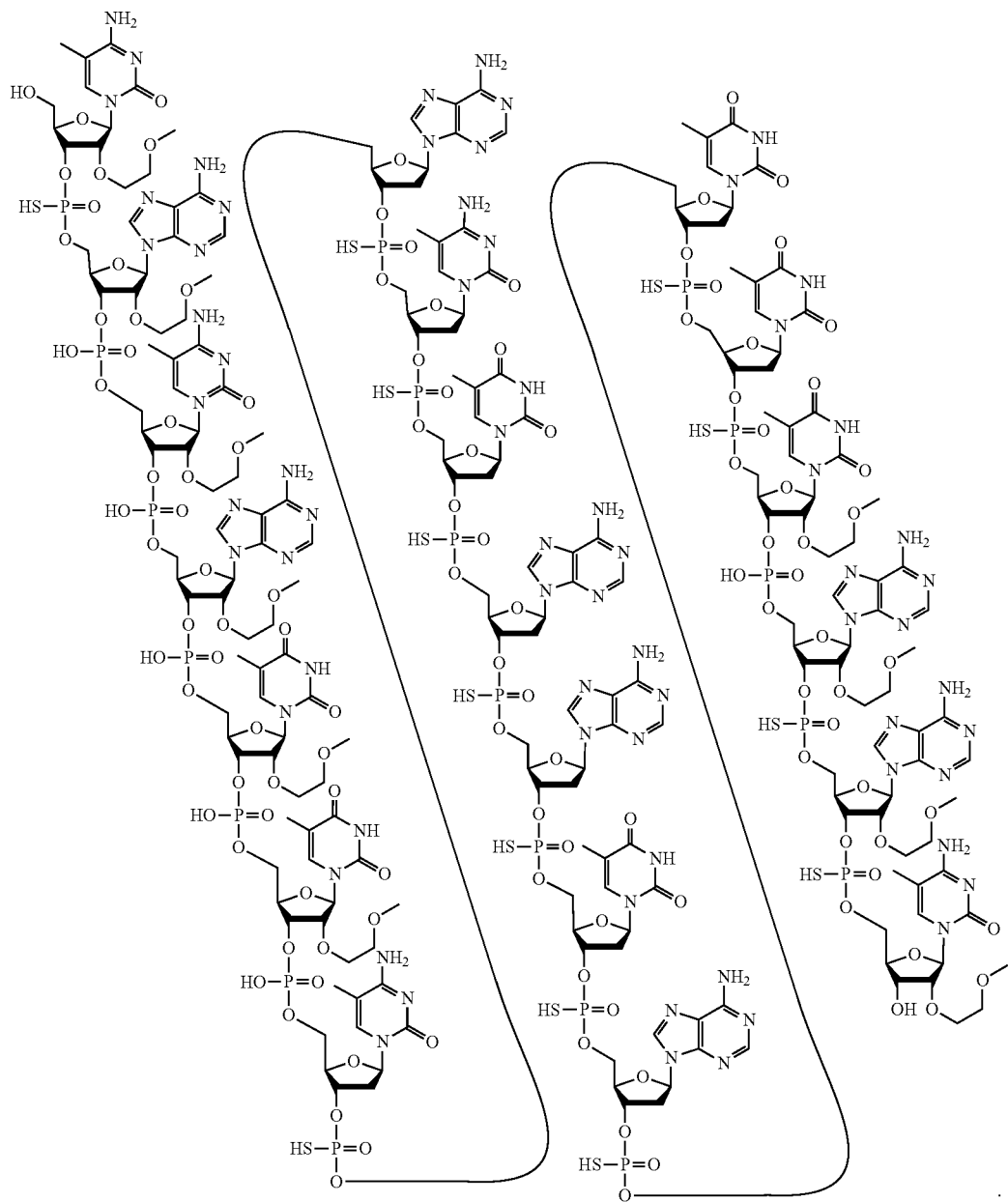

Structure 3. Compound No. 1166985

In certain embodiments, the sodium salt of Compound No. 1166985 is represented by the following chemical structure:

sides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methylcytosine.

(SEQ ID NO: 21)

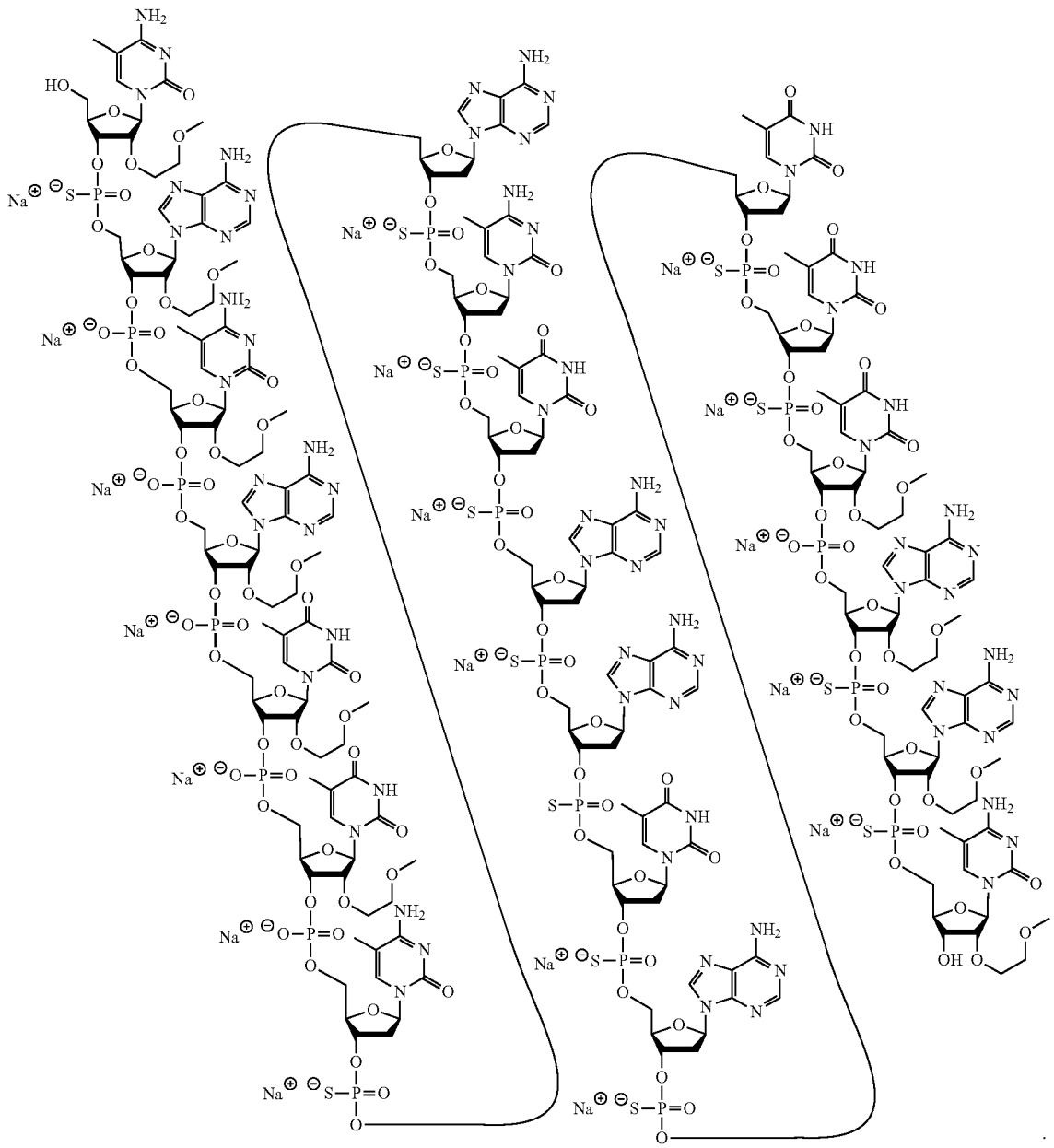

Structure 4. The Sodium Salt of Compound No. 1166985

3. Compound No. 1166954

In certain embodiments, Compound No. 1166954 is characterized as a 5-10-5 MOE gapmer having a sequence (from 5' to 3') of CCAGTGTCTTCACTTTGCTC (SEQ ID NO: 825), wherein each of nucleosides 1-5 and 16-20 (from 5' to 3') are 2'-β-D-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleo- In certain embodiments, Compound No. 1166954 is represented by the following chemical notation: $^mC_{es}{}^mC_{eo}A_{eo}G_{eo}T_{eo}G_{ds}T_{ds}{}^mC_{ds}T_{ds}T_{ds}{}^mC_{ds}A_{ds}{}^mC_{ds}T_{ds}T_{ds}T_{eo}G_{eo}{}^mC_{es}T_{es}{}^mC_e$ (SEQ ID NO: 825), wherein:

A=an adenine nucleobase, $^mC$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and
o=a phosphodiester internucleoside linkage.
In certain embodiments, Compound No. 1166954 is represented by the following chemical structure:
(SEQ ID NO: 825)
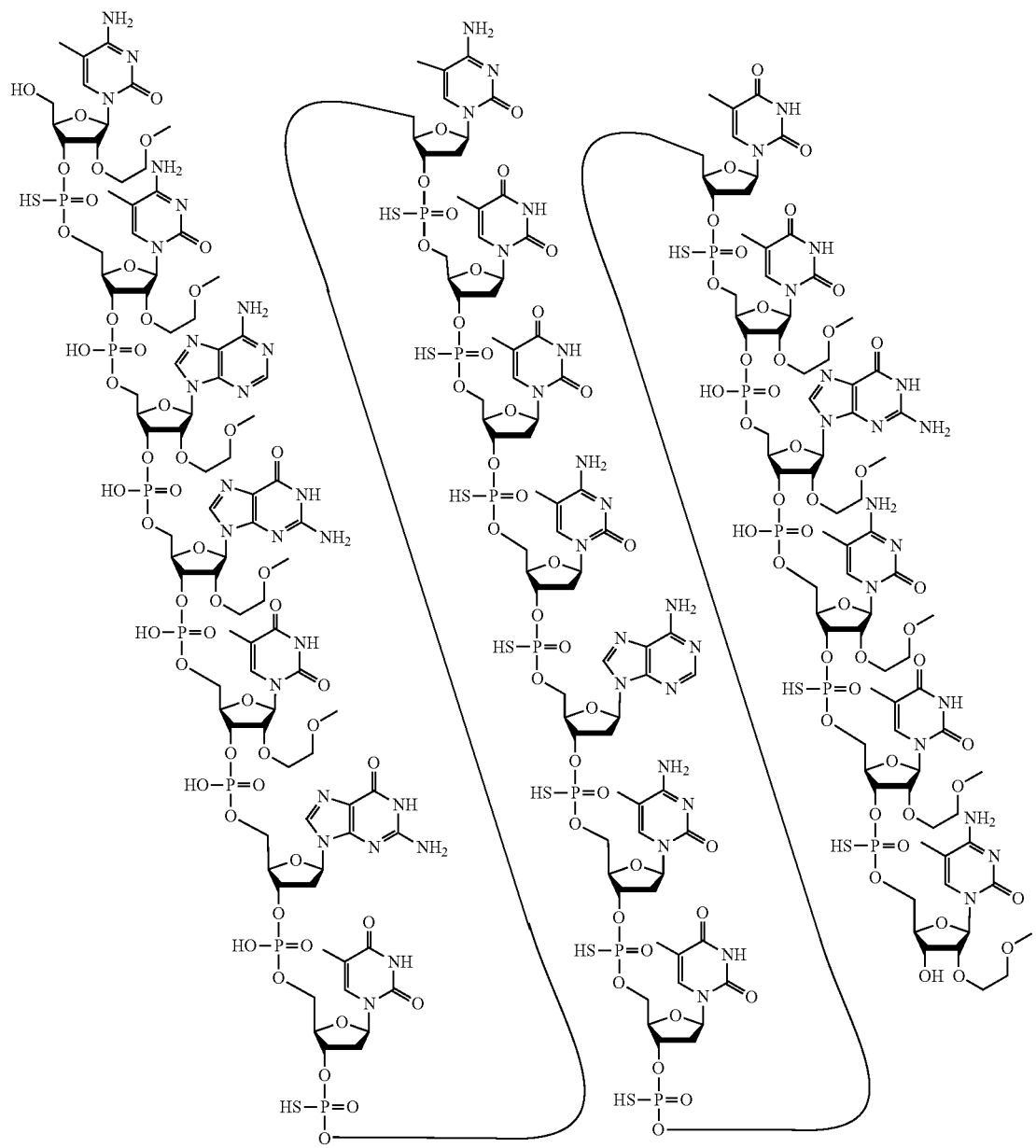

Structure 5: Compound No. 1166954

In certain embodiments, the sodium salt of Compound No. 1166954 is represented by the following chemical structure:

sides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methylcytosine.

(SEQ ID NO: 825)

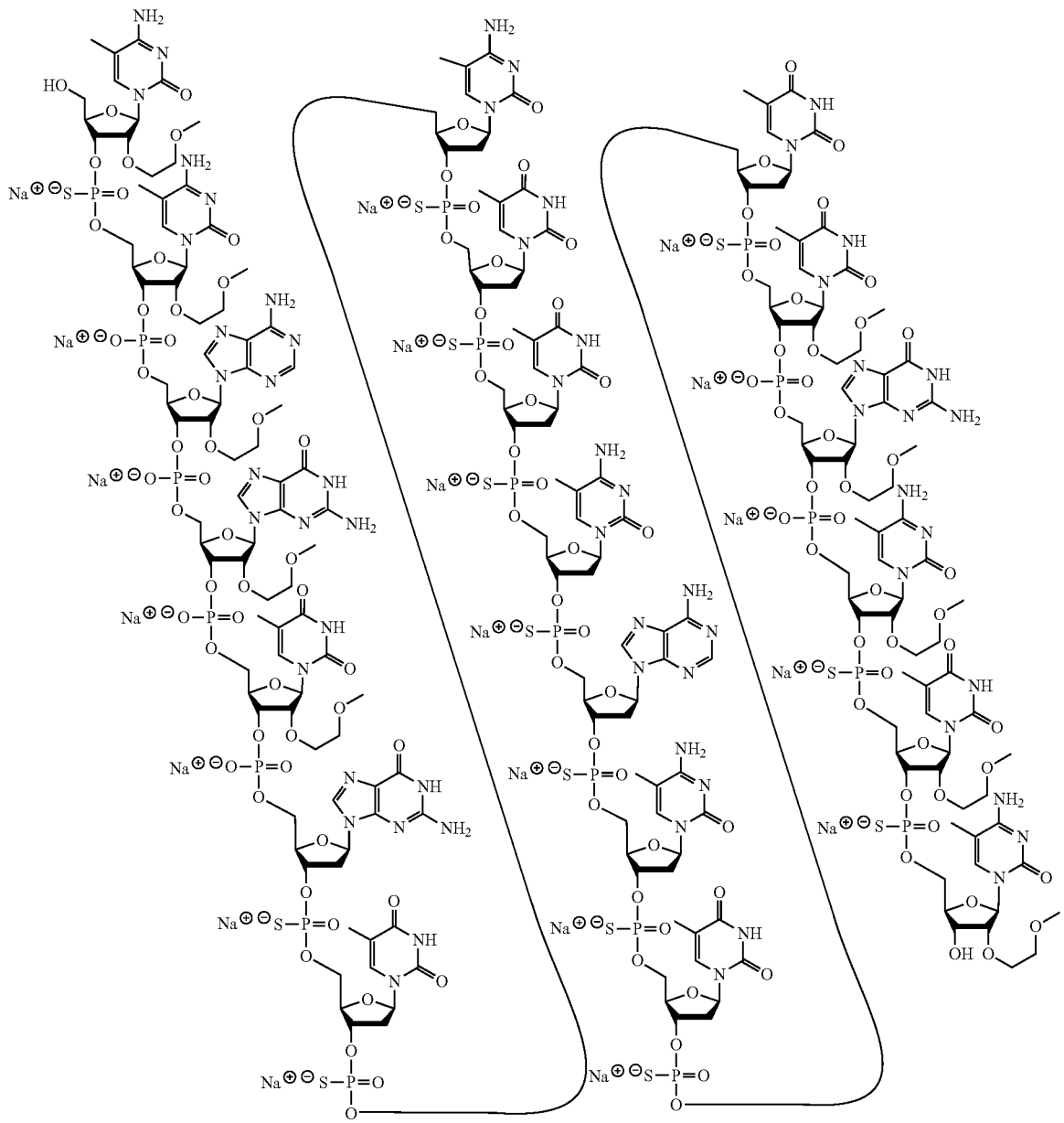

Structure 6: The Sodium Salt of Compound No. 1166954

4. Compound No. 1072813

In certain embodiments, Compound No. 1072813 is characterized as a 5-10-5 MOE gapmer having a sequence (from 5' to 3') of GCAACAGTTTCCATAACAAC (SEQ ID NO: 1499), wherein each of nucleosides 1-5 and 16-20 (from 5' to 3') are 2'-β-D-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleo- In certain embodiments, Compound No. 1072813 is represented by the following chemical notation: $G_{es}{}^mC_{eo}A_{eo}A_{eo}{}^mC_{es}A_{ds}G_{ds}T_{ds}T_{ds}T_{ds}{}^mC_{ds}{}^mC_{ds}A_{ds}T_{ds}A_{ds}A_{eo}{}^mC_{eo}A_{es}A_{es}{}^mC_e$ (SEQ ID NO: 1499), wherein:

A=an adenine nucleobase,
$^m$C=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1072813 is represented by the following chemical structure:
(SEQ ID NO: 1499)
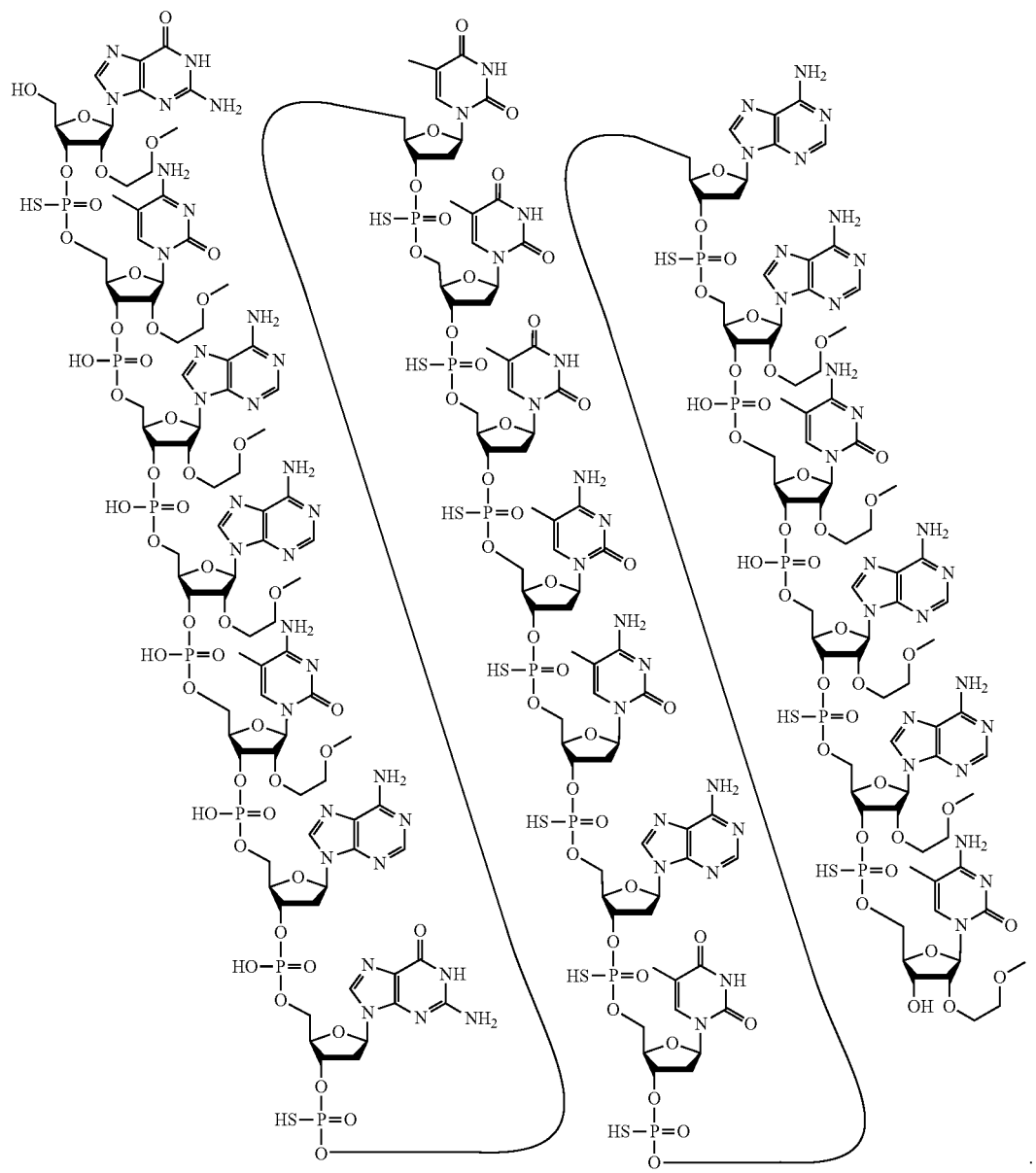

Structure 7: Compound No. 1072813

In certain embodiments, the sodium salt of Compound No. 1072813 is represented by the following chemical structure:

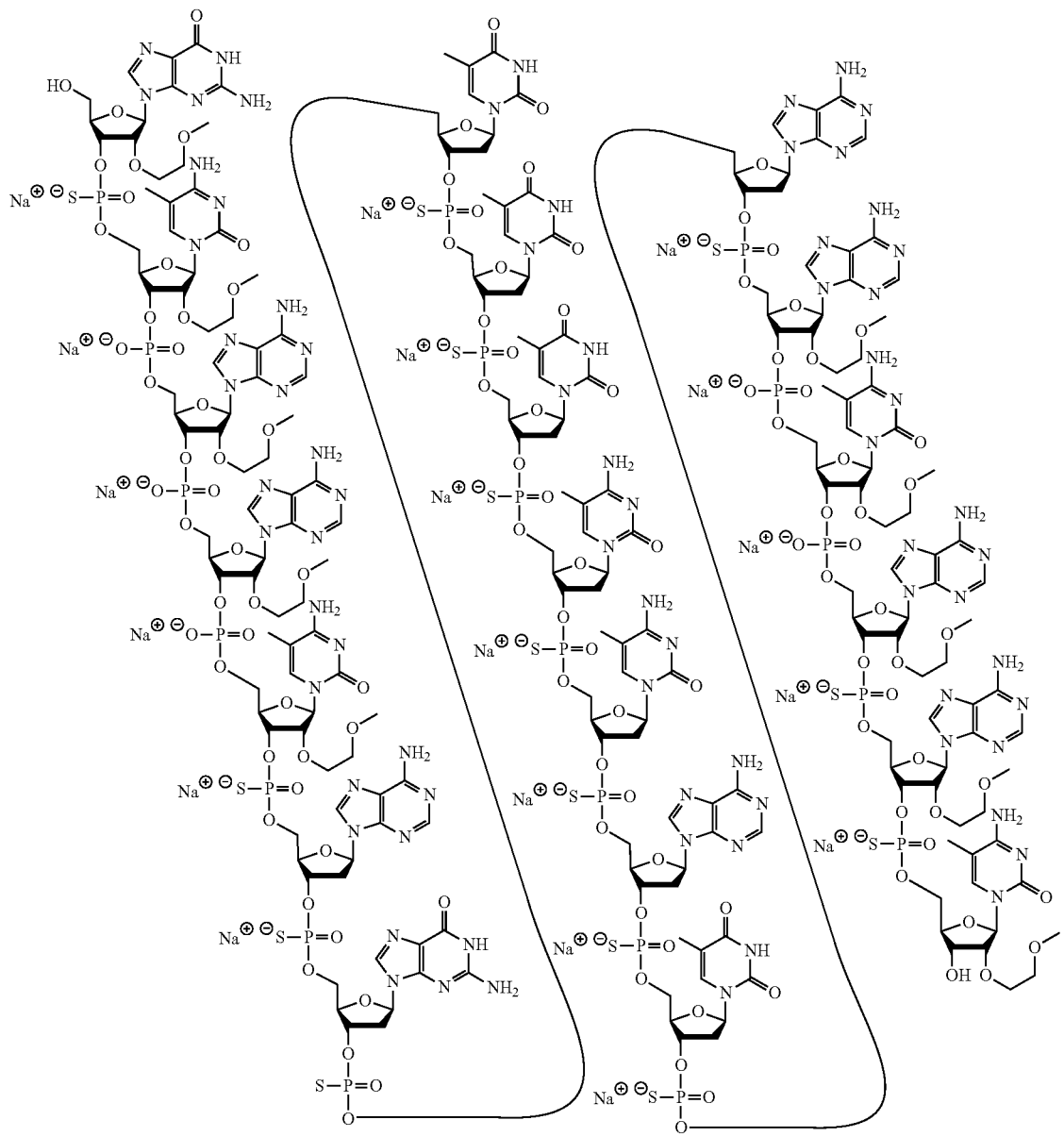

Structure 8: The Sodium Salt of Compound No. 1072813

5. Compound No. 1199983

In certain embodiments, Compound No. 1199983 is characterized as a 5-10-5 MOE gapmer having a sequence (from 5' to 3') of TGGTCCTAAATATTCTAGTC (SEQ ID NO: 2170), wherein each of nucleosides 1-5 and 16-20 (from 5' to 3') are 2'-β-D-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methylcytosine.

In certain embodiments, Compound No. 1199983 is represented by the following chemical notation: $T_{es}G_{eo}G_{eo}$- (SEQ ID NO: 1499) $T_{eo}{}^mC_{eo}{}^mC_{ds}T_{ds}A_{ds}A_{ds}A_{ds}T_{ds}A_{ds}T_{ds}T_{ds}{}^mC_{ds}T_{eo}A_{eo}G_{es}T_{es}{}^mC_e$ (SEQ ID NO: 2170), wherein:

A = an adenine nucleobase, $^m$C = a 5-methylcytosine nucleobase,

G = a guanine nucleobase,

T = a thymine nucleobase, e = a 2'-β-D-MOE sugar moiety, d = a 2'-β-D-deoxyribosyl sugar moiety, s = a phosphorothioate internucleoside linkage, and o = a phosphodiester internucleoside linkage.

In certain embodiments, Compound No. 1199983 is represented by the following chemical structure:
(SEQ ID NO: 2170)
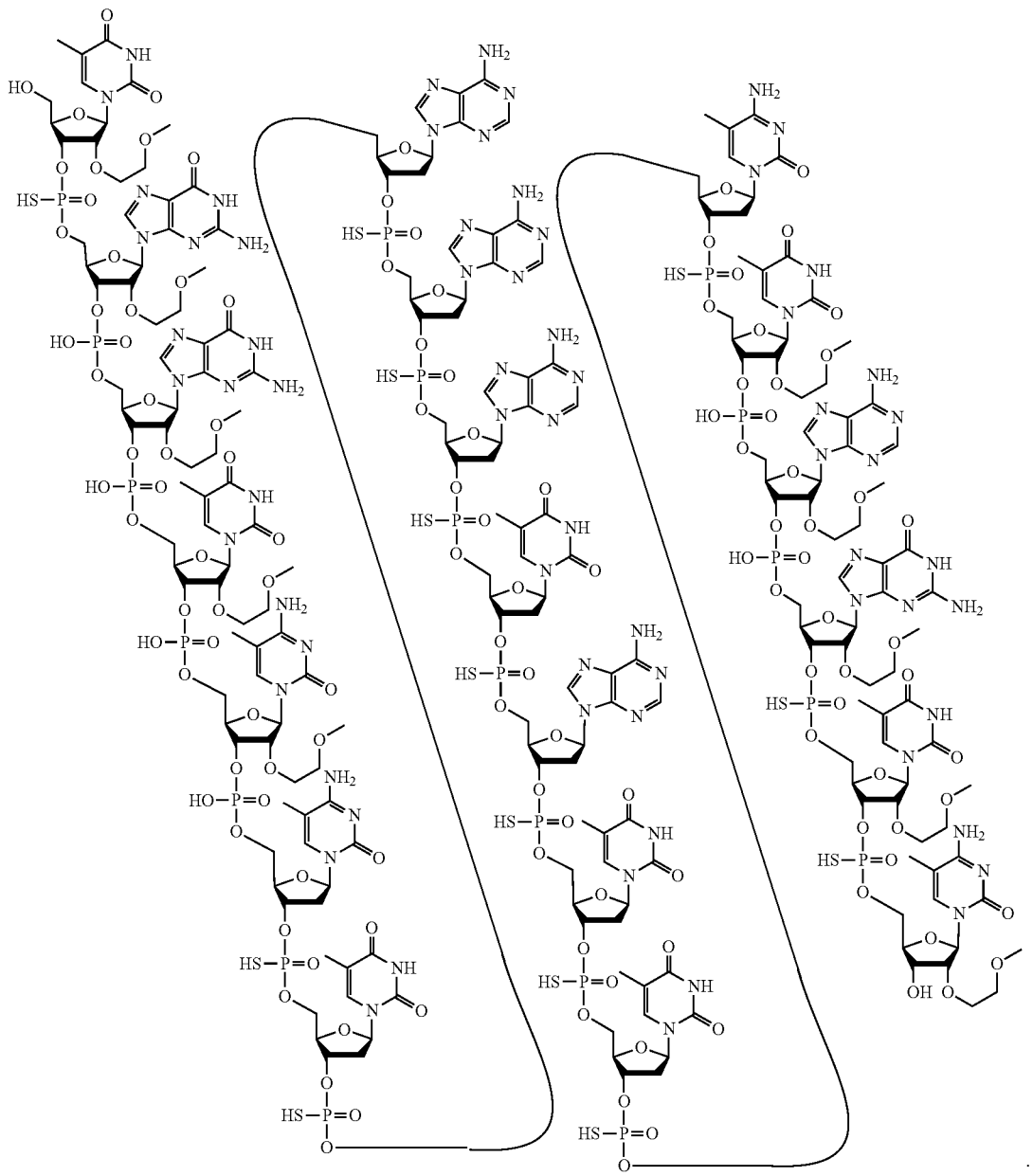

Structure 9: Compound No. 1199983

In certain embodiments, the sodium salt of Compound No. 1199983 is represented by the following chemical structure:

sides 1 to 2, 5 to 6, 6 to 7, 7 to 8, 8 to 9, 9 to 10, 10 to 11, 11 to 12, 12 to 13, 13 to 14, 16 to 17, and 17 to 18 are phosphorothioate internucleoside linkages, and wherein each cytosine is a 5-methylcytosine.

(SEQ ID NO: 2170)

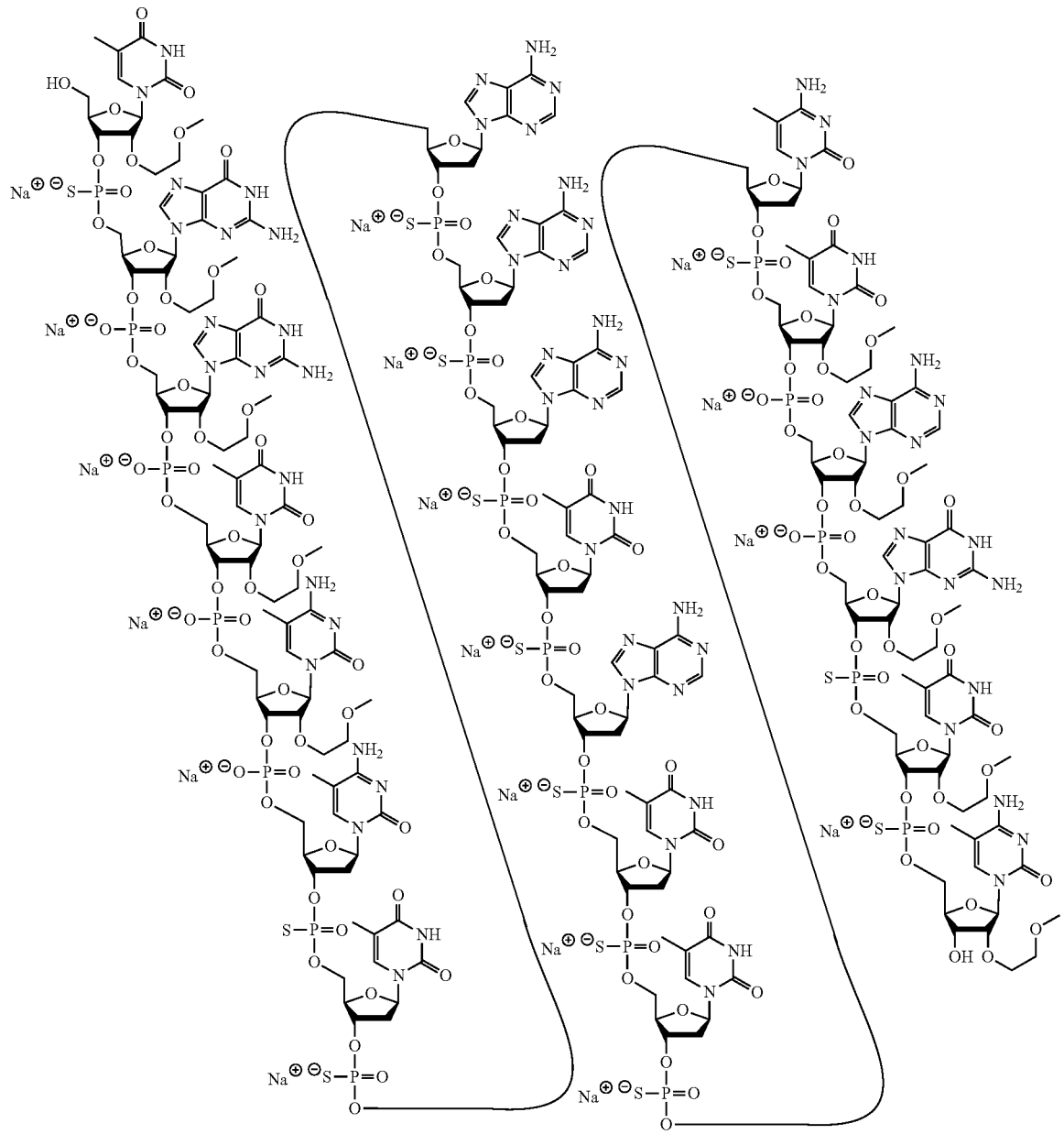

Structure 10: The Sodium Salt of Compound No. 1199983

6. Compound No. 1166721

In certain embodiments, Compound No. 1166721 is characterized as a 5-8-5 MOE gapmer having a sequence (from 5' to 3') of TGGTCCTAAATATTCTAGTC (SEQ ID NO: 2818), wherein each of nucleosides 1-5 and 14-18 (from 5' to 3') are 2'-β-D-MOE nucleosides and each of nucleosides 6-15 are 2'-β-D-deoxynucleosides, wherein the internucleoside linkages between nucleosides 2 to 3, 3 to 4, 4 to 5, 14 to 15 and 15 to 16 are phosphodiester internucleoside linkages and the internucleoside linkages between nucleo- In certain embodiments, Compound No. 1166721 is represented by the following chemical notation: $T_{es}G_{eo}G_{eo}{}^m$-$C_{eo}A_{es}G_{ds}T_{ds}A_{ds}T_{ds}T_{ds}A_{ds}{}^mC_{ds}{}^mC_{ds}T_{eo}{}^mC_{eo}T_{es}A_{es}{}^mC_{e}$ (SEQ ID NO: 2818), wherein:

A=an adenine nucleobase,
$^{m}$C=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1166721 is represented by the following chemical structure:
(SEQ ID NO: 2818)
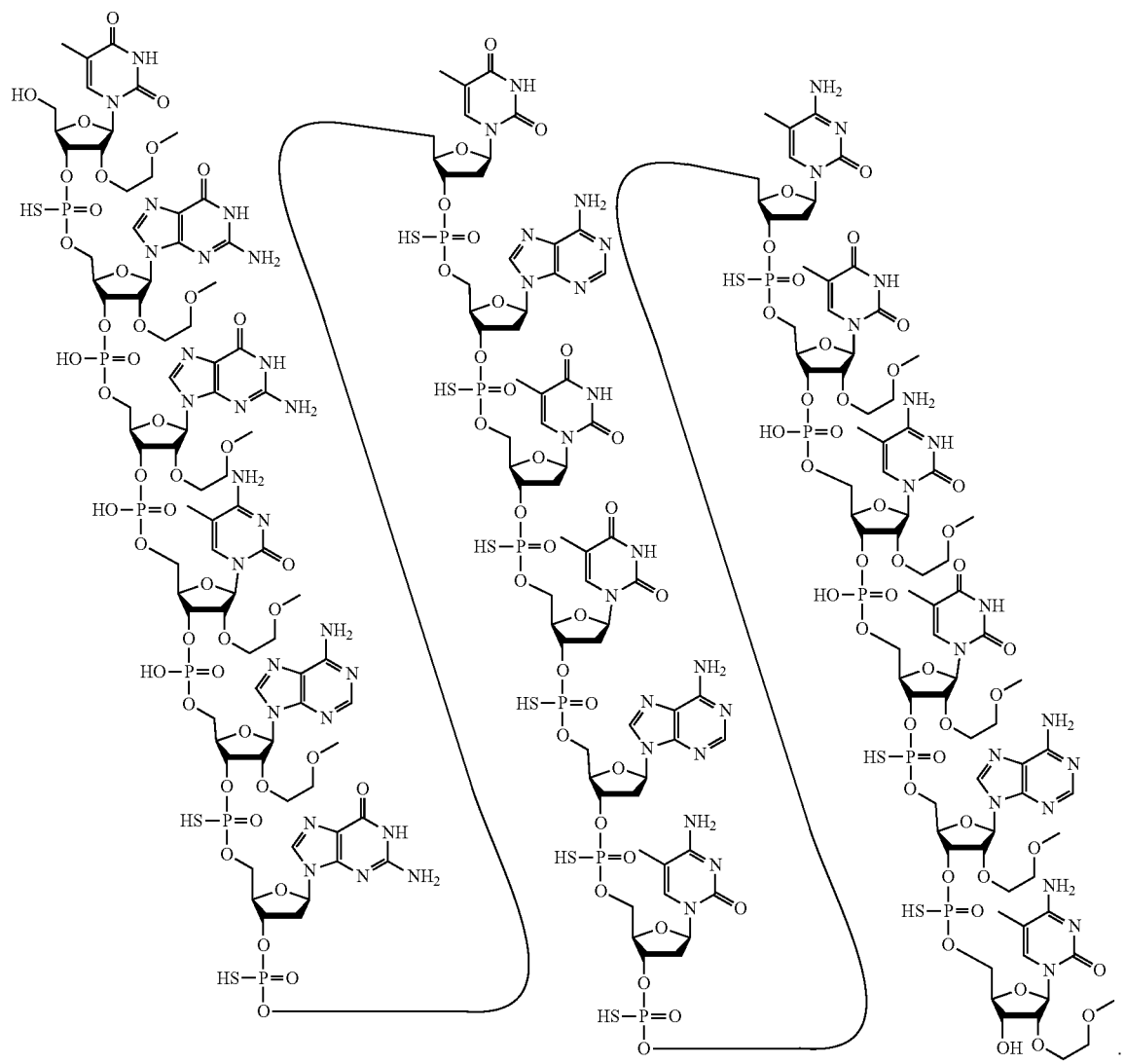

Structure 11: Compound No. 1166721

In certain embodiments, the sodium salt of Compound No. 1166721 is represented by the following chemical structure:

(SEQ ID NO: 2818)

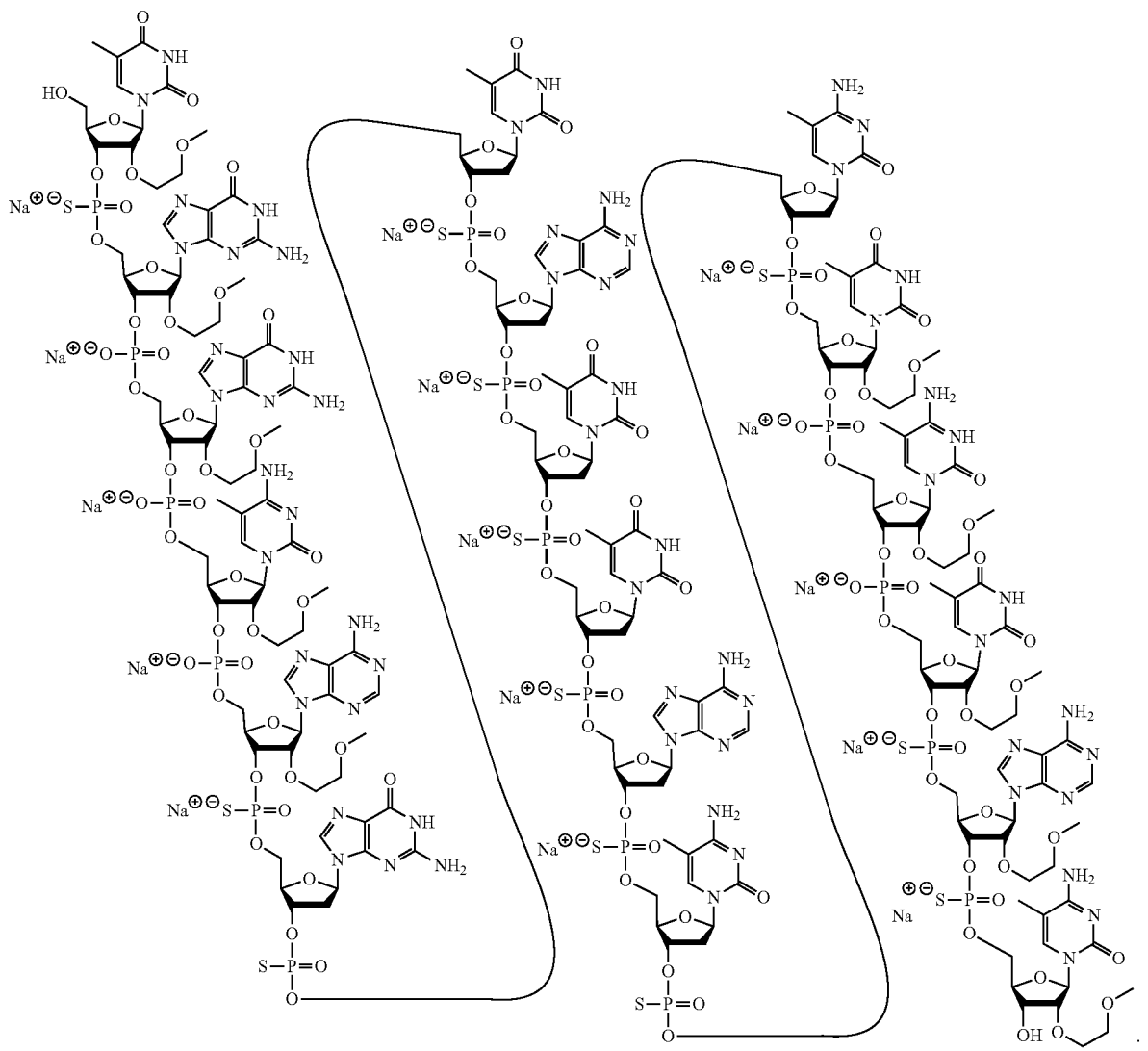

Structure 12: The sodium salt of Compound No. 1166721

VIII. Certain Hotspot Regions

In certain embodiments, nucleobases in the ranges specified below comprise a hotspot region of GFAP nucleic acid. In certain embodiments, modified oligonucleotides that are complementary to a hotspot region of GFAP nucleic acid achieve an average of more than 50% reduction of GFAP RNA in vitro in the standard cell assay. In certain embodiments, modified oligonucleotides that are complementary to a hotspot region of GFAP nucleic acid achieve an average of 75% or greater reduction of GFAP RNA in vivo in the standard in vivo assay.

1. Nucleobases 9324-9348 of SEQ ID NO: 2

In certain embodiments, nucleobases 9324-9348 of SEQ ID NO: 2 comprise a hotspot region. In certain embodiments, modified oligonucleotides are complementary to a portion of nucleobases 9324-9348 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sooooosssssssssssoss, sooosssssssss-sooss, sooossssssssssooss, or sooossssssssssoooss, wherein each "s" represents a phosphorothioate internucleoside linkage and each "o" represents a phosphodiester internucleoside linkage.

The nucleobase sequences of SEQ ID Nos: 21, 1177, 2321, 2398, 2808-2809, 2840-2842, and 2853-2854 are complementary to a portion of nucleobases 9324-9348 of SEQ ID NO: 2.

The nucleobase sequence of Compound Nos.: 1048181-1048182, 1104071-1104072, 1166746-1166748, 1166803-1166808, 1166894-1166899, 1166985-1166990, 1174016, and 1174018 are complementary to a portion of nucleobases 9324-9348 of SEQ ID NO: 2.

In certain embodiments, modified oligonucleotides complementary to a portion of nucleobases 9324-9348 of SEQ ID NO: 2 achieve at least 7% reduction of GFAP RNA in vitro in the standard cell assay. In certain embodiments, modified oligonucleotides complementary to a portion of nucleobases 9324-9348 of SEQ ID NO: 2 achieve an average of 42% reduction of GFAP RNA in vitro in the standard cell assay. In certain embodiments, modified oligonucleotides complementary to a portion of nucleobases 9324-9348 of SEQ ID NO: 2 achieve an average of 81% reduction of GFAP RNA in vivo in the standard in vivo assay.

2. Nucleobases 9459-9480 of SEQ ID NO: 2

In certain embodiments, nucleobases 9459-9480 of SEQ ID NO: 2 comprise a hotspot region. In certain embodiments, modified oligonucleotides are complementary to a portion of nucleobases 9459-9480 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss or soooossssssssssooss, wherein each "s" represents a phosphorothioate internucleoside linkage and each "o" represents a phosphodiester internucleoside linkage.

The nucleobase sequences of SEQ ID Nos: 555, 2093, 2170, and 2813 are complementary to a portion of nucleobases 9459-9480 of SEQ ID NO: 2.

The nucleobase sequence of Compound Nos.: 1048190, 1104116-1104117, and 1199982-1199984 are complementary to a portion of nucleobases 9459-9480 of SEQ ID NO: 2.

In certain embodiments, modified oligonucleotides complementary to a portion of nucleobases 9459-9480 of SEQ ID NO: 2 achieve at least 26% reduction of GFAP RNA in vitro in the standard cell assay. In certain embodiments, modified oligonucleotides complementary to a portion of nucleobases 9459-9480 of SEQ ID NO: 2 achieve an average of 42% reduction of GFAP RNA in vitro in the standard cell assay. In certain embodiments, modified oligonucleotides complementary to a portion of nucleobases 9459-9480 of SEQ ID NO: 2 achieve an average of 91% reduction of GFAP RNA in vivo in the standard in vivo assay.

3. Nucleobases 9530-9580 of SEQ ID NO: 2

In certain embodiments, nucleobases 9530-9580 of SEQ ID NO: 2 comprise a hotspot region. In certain embodiments, modified oligonucleotides are complementary to a portion of nucleobases 9530-9580 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, soooooosssssssssoss, sooooosssssssssssooss, sooosssssssssssooss, or sooossssssssssssoooss, wherein each "s" represents a phosphorothioate internucleoside linkage and each "o" represents a phosphodiester internucleoside linkage.

The nucleobase sequences of SEQ ID Nos.: 20, 88, 166, 1331, 1408, 1485, 1637, 1713, 1714, 1789, 1790, 1637, 1638, 1865, 1866, 1941, 2018, 2095, 2172, 2249, 2326, 2403, 2480, 2557, 2633, 2709, 2785, 2816-2818, 2859, 2861, and 2886-2887 are complementary to a portion of nucleobases 9530-9580 of SEQ ID NO: 2.

The nucleobase sequence of Compound Nos.: 1048200-1048201, 1073062-1073064, 1104142-1104161, 1166719-1166721, 1166816-1166823, 1166826, 1166907-1166920, 1166998-1167011, 1174024, 1174026, and 1174029-1174030 are complementary to a portion of nucleobases 9530-9580 of SEQ ID NO: 2.

In certain embodiments, modified oligonucleotides complementary to a portion of nucleobases 9530-9580 of SEQ ID NO: 2 achieve at least 27% reduction of GFAP RNA in vitro in the standard cell assay. In certain embodiments, modified oligonucleotides complementary to a portion of nucleobases 9530-9580 of SEQ ID NO: 2 achieve an average of 52% reduction of GFAP RNA in vitro in the standard cell assay. In certain embodiments, modified oligonucleotides complementary to a portion of nucleobases 9530-9580 of SEQ ID NO: 2 achieve an average of 82% reduction of GFAP RNA in vivo in the standard in vivo assay.

4. Nucleobases 12006-12038 of SEQ ID NO: 2

In certain embodiments, nucleobases 12006-12038 of SEQ ID NO: 2 comprise a hotspot region. In certain embodiments, modified oligonucleotides are complementary to a portion of nucleobases 12006-12038 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, wherein each "s" represents a phosphorothioate internucleoside linkage and each "o" represents a phosphodiester internucleoside linkage.

The nucleobase sequences of SEQ ID Nos.: 815, 893, 971, 1049, 1269, 1270, 1346, 1423, 1499, 1500, 1660, 1736, 2655, and 2731 are complementary to a portion of nucleobases 12006-12038 of SEQ ID NO: 2.

The nucleobase sequence of Compound Nos.: 1047362-1047365, 1072813-1072818, and 1103276-1103279 are complementary to a portion of nucleobases 12006-12038 of SEQ ID NO: 2.

In certain embodiments, modified oligonucleotides complementary to a portion of nucleobases 12006-12038 of SEQ ID NO: 2 achieve at least 29% reduction of GFAP RNA in vitro in the standard cell assay. In certain embodiments, modified oligonucleotides complementary to a portion of nucleobases 12006-12038 of SEQ ID NO: 2 achieve an average of 52% reduction of GFAP RNA in vitro in the standard cell assay. In certain embodiments, modified oligonucleotides complementary to a portion of nucleobases 12006-12038 of SEQ ID NO: 2 achieve an average of 82% reduction of GFAP RNA in vivo in the standard in vivo assay.

5. Nucleobases 13038-13058 of SEQ ID NO: 2

In certain embodiments, nucleobases 13038-13058 of SEQ ID NO: 2 comprise a hotspot region. In certain embodiments, modified oligonucleotides are complementary to a portion of nucleobases 13038-13058 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sooooosssssssssssoss, or sooooossssssssssssooss, wherein each "s" represents a phosphorothioate internucleoside linkage and each "o" represents a phosphodiester internucleoside linkage.

The nucleobase sequences of SEQ ID Nos.: 825 and 1973 are complementary to a portion of nucleobases 13038-13058 of SEQ ID NO: 2.

The nucleobase sequence of Compound Nos.: 1047522, 1166954, and 1167046 are complementary to a portion of nucleobases 13038-13058 of SEQ ID NO: 2.

In certain embodiments, modified oligonucleotides complementary to a portion of nucleobases 13038-13058 of SEQ ID NO: 2 achieve at least 27% reduction of GFAP RNA in vitro in the standard cell assay. In certain embodiments, modified oligonucleotides complementary to a portion of nucleobases 13038-13058 of SEQ ID NO: 2 achieve an average of 41% reduction of GFAP RNA in vitro in the standard cell assay. In certain embodiments, modified oligonucleotides complementary to a portion of nucleobases 13038-13058 of SEQ ID NO: 2 achieve an average of 84% reduction of GFAP RNA in vivo in the standard in vivo assay.

6. Additional Hotspot Regions

In certain embodiments, the ranges described in the Table below comprise hotspot regions. Each hotspot region begins with the nucleobase of SEQ ID NO: 2 identified in the "Start Site SEQ ID NO: 2" column and ends with the nucleobase of SEQ ID NO: 2 identified in the "Stop Site SEQ ID NO: 2" column. In certain embodiments, modified oligonucleotides are complementary within any of the hotspot regions 1-14, as defined in the table below. In certain embodiments, modified oligonucleotides are 18 nucleobases in length. In certain embodiments, modified oligonucleotides are 20 nucleobases in length. In certain embodiments, modified oligonucleotides are gapmers. In certain embodiments, modified oligonucleotides are 5-8-5, 5-10-3, 4-10-6, 6-10-4, or 5-10-5 MOE gapmers.

The nucleobase sequence of compounds listed in the "Compound No. in range" column in the table below are complementary to SEQ ID NO: 2 within the specified hotspot region. The nucleobase sequence of the oligonucleotides listed in the "SEQ ID NO: in range" column in the table below are complementary to the target sequence, SEQ ID NO: 2, within the specified hotspot region.

In certain embodiments, modified oligonucleotides complementary to nucleobases within the hotspot region achieve at least "Sin.% Red. in vitro" (minimum % reduction, relative to untreated control cells) of GFAP RNA in vitro in the standard cell assay, as indicated in the table below. In certain embodiments, modified oligonucleotides complementary to nucleobases within the hotspot region achieve an average of "Avg.% Red. in vitro" (average % reduction, relative to untreated control cells) of GFAP RNA in vitro in the standard cell assay, as indicated in the table below. In certain embodiments, modified oligonucleotides complementary to nucleobases within the hotspot region achieve a maximum of "Max. % Red. in vitro" (maximum % reduction, relative to untreated control cells) of GFAP RNA in vitro in the standard cell assay, as indicated in the table below. In certain embodiments, modified oligonucleotides complementary to nucleobases within the hotspot region achieve an average of "Avg. % Red. in vivo" (average % reduction, relative to PBS-treated animals) of GFAP RNA in vivo in the standard in vivo assay, as indicated in the table below.

TABLE 1

GFAP Hotspots

| Hotspot ID | Start Site SEQ ID NO: 2 | Start Site SEQ ID NO: 2 | Min. % Red. in vitro | Max. % Red. In vitro | Avg. % Red. in vitro | Avg. % Red. in vivo | Compound No. in Range | SEQ ID NOs: in Range |
|---|---|---|---|---|---|---|---|---|
| 1 | 9324 | 9348 | 7 | 78 | 42 | 81 | 1048181-1048182, 1104071-1104072, 1166746-1166748, 1166803-1166808, 1166894-1166899, 1166985-1166990, 1174016, 1174018 | 21, 1177, 2321, 2398, 2808-2809, 2840-2842, 2853-2854 |
| 2 | 9459 | 9480 | 26 | 65 | 42 | 91 | 1048190, 1104116-1104117, 1199982-1199984 | 555, 2093, 2170, 2813 |
| 3 | 9530 | 9580 | 18 | 82 | 52 | 82 | 1048199-1048201, 1073062-1073064, 1104142-1104161, 1166719-1166721, 1166816-1166823, 1166826, | 20, 88, 166, 1331, 1408, 1485, 1637, 1713, 1714, 1789, 1790, 1637, 1638, 1865, 1866, 1941, 2018, 2095, 2172, |

TABLE 1-continued

GFAP Hotspots

| Hotspot ID | Start Site SEQ ID NO: 2 | Start Site SEQ ID NO: 2 | Min. % Red. in vitro | Max. % Red. In vitro | Avg. % Red. in vitro | Avg. % Red. in vivo | Compound No. in Range | SEQ ID NOs: in Range |
|---|---|---|---|---|---|---|---|---|
| | | | | | | | 1166907-1166920, 1166998-1167011, 1174024, 1174026, 1174029-1174030 | 2249, 2326, 2403, 2480, 2557, 2633, 2709, 2785, 2816-2818, 2859, 2861, 2886-2887 |
| 4 | 12006 | 12038 | 29 | 75 | 52 | 82 | 1047362-1047365, 1072813-1072818, 1103276-1103279 | 815, 893, 971, 1049, 1269, 1270, 1346, 1423, 1499, 1500, 1660, 1736, 2655, 2731 |
| 5 | 13038 | 13058 | 27 | 56 | 41 | 84 | 1047522, 1166954, 1167046 | 825, 1973 |
| 6 | 8530 | 8557 | 14 | 79 | 52 | 89 | 1047706-1047708, 1103567-1103571 | 213, 291, 369, 1601, 1753, 1829, 1905, 1982 |
| 7 | 8731 | 8754 | 44 | 64 | 53 | 88 | 1047733-1047735, 1103591, 1103592, 1174050, 1174051, 1174056, 1174058, 1174062,1174063 | 1072, 1149, 1227, 2291, 2368 |
| 8 | 8749 | 8807 | 25 | 92 | 52 | 75 | 1047601-1047610, 1072854-1072868, 1103462-1103472, 1166738-1166740, 1166742, 1166744, 1166793-1166795, 1166798-1166800, 1166885-1166890, 1166975, 1166982, 1174012-1174013 | 51, 129, 207, 752, 830, 908, 986, 1064, 1141, 1219, 1279, 1280-1282, 1356-1359, 1433-1436, 1510-1512, 1595, 1671, 1747, 2206, 2283, 2360, 2437, 2514, 2590, 2666, 2742, 2835-2837, 2839, 2850-2851, 2866 |
| 9 | 9511 | 9536 | 32 | 90 | 55 | 86 | 1048197, 1073060, 1104129-1104133, 1166749-1166751, 1166809-1166810, 1166812-1166813, 1166900-1166903, 1166991-1166994, 1174020 | 1100, 1484, 1864, 1940, 2017, 2094, 2171, 2819-2821, 2856 |
| 10 | 9565 | 9602 | 20 | 75 | 53 | 82 | 1048202-1048204, 1073065, 1104165-1104179, 1166757-1166760, 1166831, 1166835, 1166926-1166929, 1167012, 1167017, 1167018, 1174031, 1174034 | 244, 322, 400, 1562, 1639, 1715, 1791, 1867, 1943, 2020, 2173, 2250, 2327, 2404, 2481, 2558, 2634, 2710, 2786, 2873-2876, 2888, 2891 |
| 11 | 11155 | 11184 | 37 | 82 | 69 | 85 | 1073093-1073095, 1104307-1104312, 1167024-1167027, 1166761-1166763, 1166842-1166843, 1166845-1166847, 1166933-1166934, 1167024-1167027, 1174037 | 1339, 1569, 2028, 2105, 2182, 2259, 2336, 2413, 2822-2824, 2863 |
| 12 | 12044 | 12067 | 49 | 67 | 58 | 85 | 1047372-1047374, 1072824-1072825, 1166852, 1167033-1167036 | 348, 426, 504, 1425, 1502 |
| 13 | 12080 | 12108 | 45 | 88 | 68 | 79 | 1047384-1047388, 1072834-1072835, 1103284-1103285, 1166948, 1167040 | 37, 115, 193, 271, 349, 1274, 1351, 2041, 2118 |
| 14 | 13333 | 13367 | 53 | 93 | 75 | 89 | 1047579-104592, 1072849-1072850, 1166775-1166787, 1166867, 1166869-1166875, 1166877-1166878, 1167050-1167051, 1167053-1167060 | 50, 283, 361, 439, 517, 595, 673, 751, 829, 907, 985, 1063, 1140, 1218, 1278, 1508, 2825-2833, 2843-2846 |

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar moiety (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, all cis- and trans-isomers and tautomeric forms of the compounds herein are also included unless otherwise indicated. Oligomeric compounds described herein include chirally pure or enriched mixtures as well as racemic mixtures. For example, oligomeric compounds having a plurality of phosphorothioate internucleoside linkages include such compounds in which chirality of the phosphorothioate internucleoside linkages is controlled or is random. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments.

Example 1: Effect of 5-10-5 MOE Gapmer Modified Oligonucleotides on Human GFAP RNA In Vitro, Single Dose Modified oligonucleotides complementary to human GFAP nucleic acid were designed and tested for their single dose effects on GFAP RNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-β-D-deoxynucleosides and the 5' and 3' wing segments each consists of five 2'-MOE modified nucleosides. The sugar motif for the gapmers is (from 5' to 3'): eeeeedddddddddddeeeee; wherein 'd' represents a 2'-β-D-deoxyribosyl sugar moiety, and 'e' represents a 2'-MOE sugar moiety. The internucleoside linkage motif for the gapmers is (from 5' to 3'): sooossssssssssssooss; wherein each 'o' represents a phosphodiester internucleoside linkage and each 's' represents a phosphorothioate internucleoside linkage. Each cytosine residue is a 5-methylcytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the Tables below is 100% complementary to SEQ ID NO: 1 (GENBANK Accession No. NM_002055.4), or SEQ ID NO: 2 (GENBANK Accession No. NC_000017.11 truncated from nucleotides 44903001 to 44919000). 'N/A' indicates that the modified oligonucleotide is not 100% complementary to that particular target nucleic acid sequence.

Cultured U251 cells were treated with modified oligonucleotide at a concentration of 4,000 nM using free uptake at a density of 10,000 cells per well. After a treatment period of approximately 48 hours, total RNA was isolated from the cells and GFAP RNA levels were measured by quantitative real-time RTPCR. GFAP RNA levels were measured by human GFAP primer probe set RTS37485 (forward sequence CTGGAGGTTGAGAGGGACA, designated herein as SEQ ID NO: 11; reverse sequence GCTTCATCTGCTTCCTGTCT, designated herein as SEQ ID NO: 12; probe sequence CTGGAGCTTCTGCCTCACAGTGG, designated herein as SEQ ID NO: 13). GFAP RNA levels were normalized to total RNA content, as measured by RIBOGREEN®. Reduction of GFAP RNA is presented in the tables below as percent GFAP RNA amount relative to untreated control cells. Each table represents results from an individual assay plate. The values marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 2

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047144 | 17 | 36 | 3465 | 3484 | CGAGGGCTTTATGAAGGAGT | 80 | 22 |
| 1047160 | 131 | 150 | 3579 | 3598 | GCCAGGAGCCAGGCCCCCA | 67 | 23 |
| 1047176 | 248 | 267 | 3696 | 3715 | GGCCCGGGTCTCCTTGAAGC | 109 | 24 |
| 1047192 | 488 | 507 | 3936 | 3955 | GTCCTGTGCCAGATTGTCCC | 7* | 25 |
| 1047208 | 579 | 598 | N/A | N/A | CATCTGCTTCCTGTCTATAG | 6* | 26 |
| 1047224 | 649 | 668 | 5238 | 5257 | CTCAAGAACCGGATCTCCTC | 105 | 27 |
| 1047240 | 813 | 832 | 5699 | 5718 | ACTCTTCGGCTTCATGCATG | 69 | 28 |
| 1047256 | 1029 | 1048 | 7601 | 7620 | GCGCCTCCTGATAACTGGCC | 80 | 29 |
| 1047272 | 1251 | 1270 | 10865 | 10884 | CTTCTGACACAGACTTGGTG | 92 | 30 |
| 1047288 | 1298 | 1317 | 10912 | 10931 | ATCCCGCATCTCCACGGTCT | 90 | 31 |
| 1047304 | 1351 | 1370 | 11640 | 11659 | CTGCCTCACATCACATCCTT | 87 | 32 |
| 1047320 | 1416 | 1435 | 11705 | 11724 | CGGAGCAACTATCCTGCTTC | 102 | 33 |
| 1047336 | 1617 | 1636 | 11906 | 11925 | AAGCTGCTGGCCATGCCCCT | 87 | 34 |
| 1047352 | 1664 | 1683 | 11953 | 11972 | TGCCCCCGCCCTCCTCCCC | 83 | 35 |
| 1047368 | 1736 | 1755 | 12025 | 12044 | GAGAGAACCTCCATCTCTGG | 47 | 36 |
| 1047384 | 1791 | 1810 | 12080 | 12099 | TCAGTTTTCCTCCAGCAGCC | 55 | 37 |
| 1047400 | 1854 | 1873 | 12143 | 12162 | GACAAAACAAGCCTCTGGCC | 66 | 38 |
| 1047416 | 2036 | 2055 | 12325 | 12344 | CGTCCCCACCCATCTTAGAC | 60 | 39 |
| 1047432 | 2180 | 2199 | 12469 | 12488 | GTGCTGAGAATCAAGCTCCC | 93 | 40 |
| 1047448 | 2237 | 2256 | 12526 | 12545 | CCCCCTCTATCCCTCCCAGC | 11 | 41 |
| 1047464 | 2280 | 2299 | 12569 | 12588 | CTGGGCTTGACCTCTCTGTA | 63 | 42 |
| 1047480 | 2379 | 2398 | 12668 | 12687 | TGGTCACCCACAACCCCTAC | 81 | 43 |
| 1047496 | 2457 | 2476 | 12746 | 12765 | CCCTTTCTCTCCTGTTTCAG | 79 | 44 |
| 1047512 | 2486 | 2505 | 12775 | 12794 | AAGTCATGCCCTGCCCCCAT | 45 | 45 |
| 1047528 | 2780 | 2799 | 13069 | 13088 | GCACCCGGCCTCCAGGCTGC | 76 | 46 |
| 1047544 | 2861 | 2880 | 13150 | 13169 | GGCACAGATCCCACCAGTCT | 106 | 47 |
| 1047560 | 2903 | 2922 | 13192 | 13211 | GAGAGGAGAACCCTGAAGTG | 72 | 48 |
| 1047576 | 3035 | 3054 | 13324 | 13343 | CCTCAGCGACTAAAGGCAGC | 77 | 49 |
| 1047592 | 3058 | 3077 | 13347 | 13366 | GCGCAGCATTTGTCTTTATT | 47 | 50 |
| 1047608 | N/A | N/A | 8777 | 8796 | GCTTTTGAGATATCTTGTGA | 8 | 51 |
| 1047624 | N/A | N/A | 9031 | 9050 | GTTTAATGTACAGTTACTCT | 71 | 52 |
| 1047640 | N/A | N/A | 9070 | 9089 | CCAAGGACTCACCACCTTTA | 75 | 53 |
| 1047656 | N/A | N/A | 9202 | 9221 | AGGGATGAAAGAATAAAGCA | 92 | 54 |

TABLE 2-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047672 | N/A | N/A | 8381 | 8400 | CCTGCTGTACTGACCTCGAA | 94 | 55 |
| 1047688 | N/A | N/A | 8456 | 8475 | ATCCTCAGTCCCAGTCTGGA | 54 | 56 |
| 1047704 | N/A | N/A | 8504 | 8523 | CTGCAGTGTCACGAAGGCCC | 74 | 57 |
| 1047720 | N/A | N/A | 8637 | 8656 | TGTCAAGCTCTCACCCAGTT | 77 | 58 |
| 1047736 | N/A | N/A | 8737 | 8756 | TTGGTGCTTTTGCCCCCTGT | 56 | 59 |
| 1047752 | N/A | N/A | 4093 | 4112 | GGATAGTGCCCCATCAAGAG | 109 | 60 |
| 1047768 | N/A | N/A | 4264 | 4283 | AGTCACAAAGCCCAGCCATG | 95 | 61 |
| 1047784 | N/A | N/A | 4322 | 4341 | GCTTCCAACTCCTCCTTTAT | 101 | 62 |
| 1047800 | N/A | N/A | 4359 | 4378 | CAGAATCCAATCTCCCTCAT | 106 | 63 |
| 1047816 | N/A | N/A | 4405 | 4424 | GCTTTGCGCCCAGACCTGCC | 68 | 64 |
| 1047832 | N/A | N/A | 4525 | 4544 | ATTCCTCTGATCCCAGGTAA | 52 | 65 |
| 1047848 | N/A | N/A | 4704 | 4723 | CCTTAACTCATTACTAAGGT | 69 | 66 |
| 1047864 | N/A | N/A | 4806 | 4825 | GAGACCACCCCCACCCAGGA | 70 | 67 |
| 1047880 | N/A | N/A | 4868 | 4887 | GTCCAGGCTCTTCTGAGGAC | 66 | 68 |
| 1047896 | N/A | N/A | 5007 | 5026 | GTGGCCATCAATCCTTTCCT | 103 | 69 |
| 1047912 | N/A | N/A | 5117 | 5136 | CCCCAGGCTCCTTCTCCCCA | 74 | 70 |
| 1047928 | N/A | N/A | 5388 | 5407 | TGTCTCTACCTGCCAATCTC | 100 | 71 |
| 1047944 | N/A | N/A | 5521 | 5540 | CTCAGGGTACAGGCCACAGC | 90 | 72 |
| 1047960 | N/A | N/A | 5791 | 5810 | ACCCTCCTTCCCCCATTCTC | 94 | 73 |
| 1047976 | N/A | N/A | 5934 | 5953 | AGCTACTACTAATAATAGCA | 98 | 74 |
| 1047992 | N/A | N/A | 6023 | 6042 | ACTTCGGCTCTCTCATCTGT | 75 | 75 |
| 1048008 | N/A | N/A | 6146 | 6165 | AACCCAAAACAGACTGGCAG | 79 | 76 |
| 1048024 | N/A | N/A | 6281 | 6300 | CCCACACTACATATAAGCTC | 105 | 77 |
| 1048040 | N/A | N/A | 6329 | 6348 | CCTGTCCTGCCTAGCCCAAA | 71 | 78 |
| 1048056 | N/A | N/A | 6417 | 6436 | GGGCCCTGCCTCTCTGTGCT | 81 | 79 |
| 1048072 | N/A | N/A | 6544 | 6563 | ATAGCCCTTTCTCCCCTGCC | 86 | 80 |
| 1048088 | N/A | N/A | 6959 | 6978 | AATCCAGAACCTTCCACACT | 114 | 81 |
| 1048104 | N/A | N/A | 7073 | 7092 | TGGGACTTTTCCCAACAACT | 93 | 82 |
| 1048120 | N/A | N/A | 7412 | 7431 | CGCCCTCGACCCAGGTCCTC | 57 | 83 |
| 1048136 | N/A | N/A | 7907 | 7926 | AGTGACTGCCTGCTATGTGT | 94 | 84 |
| 1048152 | N/A | N/A | 7989 | 8008 | TTGGAGGGTGACCCAAGTCC | 81 | 85 |
| 1048168 | N/A | N/A | 8235 | 8254 | ACGCCCTTTTCCTTGCCAGG | 74 | 86 |
| 1048184 | N/A | N/A | 9373 | 9392 | TAGCTCCCCCTCCCCCCGC | 52 | 87 |
| 1048200 | N/A | N/A | 9534 | 9553 | GCAGTATTACCTCTACTAGT | 45 | 88 |
| 1048216 | N/A | N/A | 9610 | 9629 | CCTGTCCCTTTCCTCTTTC | 74 | 89 |
| 1048232 | N/A | N/A | 9791 | 9810 | CCACCAACCAGCCACATGAC | 98 | 90 |

TABLE 2-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048248 | N/A | N/A | 9826 | 9845 | ATCAGGAGACCAGAGCTCAA | 78 | 91 |
| 1048264 | N/A | N/A | 10622 | 10641 | GGCCTGGCTTCATTTCAGCC | 66 | 92 |
| 1048280 | N/A | N/A | 10734 | 10753 | AGTATGAGAACCTATGCAAC | 80 | 93 |
| 1048296 | N/A | N/A | 10793 | 10812 | GGGCATGAGCCATCCTCTCC | 35 | 94 |
| 1048312 | N/A | N/A | 10942 | 10961 | GACTGGGCCCAAATCCCTCC | 87 | 95 |
| 1048328 | N/A | N/A | 11063 | 11082 | CCTTGCTCTCCTCCAGAATT | 67 | 96 |
| 1048344 | N/A | N/A | 11227 | 11246 | GCTACTAACTTTAATTCTCT | 41 | 97 |
| 1048360 | N/A | N/A | 11321 | 11340 | CCTCTTCCCATTCCCCTGGT | 62 | 98 |
| 1048376 | N/A | N/A | 11488 | 11507 | GGTCTTACTTTTCTTGATAG | 72 | 99 |

TABLE 3

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047145 | 18 | 37 | 3466 | 3485 | GCGAGGGCTTTATGAAGGAG | 99 | 100 |
| 1047161 | 133 | 152 | 3581 | 3600 | CGGCCAGGAGCCAGGCCCCC | 82 | 101 |
| 1047177 | 267 | 286 | 3715 | 3734 | TCATCTCTGCCCGCTCACTG | 88 | 102 |
| 1047193 | 490 | 509 | 3938 | 3957 | AGGTCCTGTGCCAGATTGTC | 8* | 103 |
| 1047209 | 585 | 604 | N/A | N/A | TGGCTTCATCTGCTTCCTGT | 5* | 104 |
| 1047225 | 651 | 670 | 5240 | 5259 | TCCTCAAGAACCGGATCTCC | 37 | 105 |
| 1047241 | 821 | 840 | 5707 | 5726 | GCGGTACCACTCTTCGGCTT | 77 | 106 |
| 1047257 | 1051 | 1070 | 7623 | 7642 | CCCTCTTCCTCCAGCCGCGC | 35 | 107 |
| 1047273 | 1252 | 1271 | 10866 | 10885 | CCTTCTGACACAGACTTGGT | 86 | 108 |
| 1047289 | 1305 | 1324 | 10919 | 10938 | CCTCTCCATCCCGCATCTCC | 87 | 109 |
| 1047305 | 1352 | 1371 | 11641 | 11660 | CCTGCCTCACATCACATCCT | 66 | 110 |
| 1047321 | 1417 | 1436 | 11706 | 11725 | GCGGAGCAACTATCCTGCTT | 96 | 111 |
| 1047337 | 1631 | 1650 | 11920 | 11939 | CCTCATTCTAACGCAAGCTG | 58 | 112 |
| 1047353 | 1665 | 1684 | 11954 | 11973 | GTGCCCCCGCCCTCCTCCC | 46 | 113 |
| 1047369 | 1739 | 1758 | 12028 | 12047 | TCCGAGAGAACCTCCATCTC | 72 | 114 |
| 1047385 | 1792 | 1811 | 12081 | 12100 | CTCAGTTTTCCTCCAGCAGC | 50 | 115 |
| 1047401 | 1876 | 1895 | 12165 | 12184 | TCCCACCTCATAAAAACCAA | 94 | 116 |
| 1047417 | 2059 | 2078 | 12348 | 12367 | GGTGACTGCCCCAGGTGGCA | 68 | 117 |
| 1047433 | 2181 | 2200 | 12470 | 12489 | AGTGCTGAGAATCAAGCTCC | 75 | 118 |
| 1047449 | 2238 | 2257 | 12527 | 12546 | CCCCCCTCTATCCCTCCCAG | 60 | 119 |
| 1047465 | 2310 | 2329 | 12599 | 12618 | GTCCCCTCCAGTCTGCACGG | 49 | 120 |

TABLE 3-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047481 | 2380 | 2399 | 12669 | 12688 | CTGGTCACCCACAACCCCTA | 82 | 121 |
| 1047497 | 2458 | 2477 | 12747 | 12766 | CCCCTTTCTCTCCTGTTTCA | 29 | 122 |
| 1047513 | 2491 | 2510 | 12780 | 12799 | GGACAAAGTCATGCCCTGCC | 85 | 123 |
| 1047529 | 2781 | 2800 | 13070 | 13089 | AGCACCCGGCCTCCAGGCTG | 86 | 124 |
| 1047545 | 2862 | 2881 | 13151 | 13170 | GGGCACAGATCCCACCAGTC | 65 | 125 |
| 1047561 | 2924 | 2943 | 13213 | 13232 | CCCTTCTTCGGCCTTAGAGG | 62 | 126 |
| 1047577 | 3040 | 3059 | 13329 | 13348 | TTTTTCCTCAGCGACTAAAG | 49 | 127 |
| 1047593 | 3060 | 3079 | 13349 | 13368 | GGGCGCAGCATTTGTCTTTA | 59 | 128 |
| 1047609 | N/A | N/A | 8778 | 8797 | GGCTTTTGAGATATCTTGTG | 13 | 129 |
| 1047625 | N/A | N/A | 9036 | 9055 | TGCCAGTTTAATGTACAGTT | 72 | 130 |
| 1047641 | N/A | N/A | 9072 | 9091 | ACCCAAGGACTCACCACCTT | 89 | 131 |
| 1047657 | N/A | N/A | 9212 | 9231 | ATGGAGCCTCAGGGATGAAA | 69 | 132 |
| 1047673 | N/A | N/A | 8382 | 8401 | CCCTGCTGTACTGACCTCGA | 91 | 133 |
| 1047689 | N/A | N/A | 8460 | 8479 | CCTGATCCTCAGTCCCAGTC | 82 | 134 |
| 1047705 | N/A | N/A | 8506 | 8525 | CGCTGCAGTGTCACGAAGGC | 63 | 135 |
| 1047721 | N/A | N/A | 8643 | 8662 | GGCAGATGTCAAGCTCTCAC | 83 | 136 |
| 1047737 | N/A | N/A | 3963 | 3982 | TCCTCACTTCTGCCTCACAG | 66 | 137 |
| 1047753 | N/A | N/A | 4095 | 4114 | AAGGATAGTGCCCCATCAAG | 69 | 138 |
| 1047769 | N/A | N/A | 4265 | 4284 | CAGTCACAAAGCCCAGCCAT | 64 | 139 |
| 1047785 | N/A | N/A | 4324 | 4343 | CCGCTTCCAACTCCTCCTTT | 49 | 140 |
| 1047801 | N/A | N/A | 4361 | 4380 | CCCAGAATCCAATCTCCCTC | 85 | 141 |
| 1047817 | N/A | N/A | 4419 | 4438 | AGGCAGTCACCTGTGCTTTG | 96 | 142 |
| 1047833 | N/A | N/A | 4526 | 4545 | GATTCCTCTGATCCCAGGTA | 63 | 143 |
| 1047849 | N/A | N/A | 4705 | 4724 | GCCTTAACTCATTACTAAGG | 82 | 144 |
| 1047865 | N/A | N/A | 4807 | 4826 | AGAGACCACCCCCACCCAGG | 91 | 145 |
| 1047881 | N/A | N/A | 4910 | 4929 | TGGTTTCATCCTGGAGCCTG | 60 | 146 |
| 1047897 | N/A | N/A | 5012 | 5031 | GGTGGGTGGCCATCAATCCT | 71 | 147 |
| 1047913 | N/A | N/A | 5168 | 5187 | CATCTGCTTCCTGGAGTGGC | 31 | 148 |
| 1047929 | N/A | N/A | 5400 | 5419 | TCTTTCATTTCCTGTCTCTA | 81 | 149 |
| 1047945 | N/A | N/A | 5561 | 5580 | CCCGAACCTCCTGACCAGGG | 117 | 150 |
| 1047961 | N/A | N/A | 5800 | 5819 | GCTTCCTCCACCCTCCTTCC | 75 | 151 |
| 1047977 | N/A | N/A | 5935 | 5954 | CAGCTACTACTAATAATAGC | 104 | 152 |
| 1047993 | N/A | N/A | 6040 | 6059 | TTAGTTAACCTCTCTGGACT | 79 | 153 |
| 1048009 | N/A | N/A | 6147 | 6166 | TAACCCAAAACAGACTGGCA | 101 | 154 |
| 1048025 | N/A | N/A | 6282 | 6301 | TCCCACACTACATATAAGCT | 83 | 155 |
| 1048041 | N/A | N/A | 6330 | 6349 | GCCTGTCCTGCCTAGCCCAA | 80 | 156 |

TABLE 3-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048057 | N/A | N/A | 6464 | 6483 | GCCACTCACACTCCTCAGCT | 79 | 157 |
| 1048073 | N/A | N/A | 6548 | 6567 | TCTAATAGCCCTTTCTCCCC | 88 | 158 |
| 1048089 | N/A | N/A | 6961 | 6980 | AGAATCCAGAACCTTCCACA | 88 | 159 |
| 1048105 | N/A | N/A | 7074 | 7093 | CTGGGACTTTTCCCAACAAC | 86 | 160 |
| 1048121 | N/A | N/A | 7418 | 7437 | AGGCCCGCCCTCGACCCAG | 95 | 161 |
| 1048137 | N/A | N/A | 7915 | 7934 | AAACATCTAGTGACTGCCTG | 87 | 162 |
| 1048153 | N/A | N/A | 8061 | 8080 | AAGGAGGCAGAAGAGATGGG | 59 | 163 |
| 1048169 | N/A | N/A | 8286 | 8305 | CTGGGACACCCCTAGGCTGG | 68 | 164 |
| 1048185 | N/A | N/A | 9374 | 9393 | TTAGCTCCCCCCTCCCCCG | 84 | 165 |
| 1048201 | N/A | N/A | 9536 | 9555 | TGGCAGTATTACCTCTACTA | 43 | 166 |
| 1048217 | N/A | N/A | 9611 | 9630 | TCCTGTCCCCTTTCCTCTTT | 63 | 167 |
| 1048233 | N/A | N/A | 9792 | 9811 | GCCACCAACCAGCCACATGA | 89 | 168 |
| 1048249 | N/A | N/A | 10005 | 10024 | CTGTAATCCCCTTACTCGGG | 94 | 169 |
| 1048265 | N/A | N/A | 10636 | 10655 | CTGCTCTGTCTTCTGGCCTG | 65 | 170 |
| 1048281 | N/A | N/A | 10735 | 10754 | GAGTATGAGAACCTATGCAA | 53 | 171 |
| 1048297 | N/A | N/A | 10794 | 10813 | AGGGCATGAGCCATCCTCTC | 78 | 172 |
| 1048313 | N/A | N/A | 10944 | 10963 | CTGACTGGGCCCAAATCCCT | 95 | 173 |
| 1048329 | N/A | N/A | 11074 | 11093 | ACATTCAGTTTCCTTGCTCT | 89 | 174 |
| 1048345 | N/A | N/A | 11228 | 11247 | AGCTACTAACTTTAATTCTC | 82 | 175 |
| 1048361 | N/A | N/A | 11330 | 11349 | GCCAAATCCCTCTTCCCAT | 19 | 176 |
| 1048377 | N/A | N/A | 11491 | 11510 | CCAGGTCTTACTTTTCTTGA | 85 | 177 |

TABLE 4

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047146 | 58 | 77 | 3506 | 3525 | CTCCTCTCCATCCTGCTCTG | 94 | 178 |
| 1047162 | 138 | 157 | 3586 | 3605 | GACGGCGGCCAGGAGCCAGG | 115 | 179 |
| 1047178 | 274 | 293 | 3722 | 3741 | AGCTCCATCATCTCTGCCCG | 117 | 180 |
| 1047194 | 495 | 514 | 3943 | 3962 | TGGCCAGGTCCTGTGCCAGA | 67* | 181 |
| 1047210 | 588 | 607 | 5177 | 5196 | GGGTGGCTTCATCTGCTTCC | 18* | 182 |
| 1047226 | 656 | 675 | 5245 | 5264 | GATCTTCCTCAAGAACCGGA | 62 | 183 |
| 1047242 | 822 | 841 | 5708 | 5727 | AGCGGTACCACTCTTCGGCT | 113 | 184 |
| 1047258 | 1052 | 1071 | 7624 | 7643 | CCCCTCTTCCTCCAGCCGCG | 16 | 185 |

TABLE 4-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047274 | 1253 | 1272 | 10867 | 10886 | GCCTTCTGACACAGACTTGG | 113 | 186 |
| 1047290 | 1309 | 1328 | N/A | N/A | ATGACCTCTCCATCCCGCAT | 108 | 187 |
| 1047306 | 1353 | 1372 | 11642 | 11661 | TCCTGCCTCACATCACATCC | 75 | 188 |
| 1047322 | 1499 | 1518 | 11788 | 11807 | GCAAGCTGACCTAGGGACAG | 68 | 189 |
| 1047338 | 1632 | 1651 | 11921 | 11940 | TCCTCATTCTAACGCAAGCT | 68 | 190 |
| 1047354 | 1666 | 1685 | 11955 | 11974 | GGTGCCCCCGCCCTCCTCC | 90 | 191 |
| 1047370 | 1740 | 1759 | 12029 | 12048 | CTCCGAGAGAACCTCCATCT | 77 | 192 |
| 1047386 | 1793 | 1812 | 12082 | 12101 | TCTCAGTTTTCCTCCAGCAG | 33 | 193 |
| 1047402 | 1888 | 1907 | 12177 | 12196 | AGCATAGGGATATCCCACCT | 63 | 194 |
| 1047418 | 2063 | 2082 | 12352 | 12371 | GGCAGGTGACTGCCCCAGGT | 106 | 195 |
| 1047434 | 2182 | 2201 | 12471 | 12490 | AAGTGCTGAGAATCAAGCTC | 103 | 196 |
| 1047450 | 2239 | 2258 | 12528 | 12547 | GCCCCCTCTATCCCTCCCA | 103 | 197 |
| 1047466 | 2329 | 2348 | 12618 | 12637 | CTCCTCCATCTCTACCAGCG | 52 | 198 |
| 1047482 | 2381 | 2400 | 12670 | 12689 | ACTGGTCACCCACAACCCCT | 79 | 199 |
| 1047498 | 2461 | 2480 | 12750 | 12769 | CATCCCCTTTCTCTCCTGTT | 74 | 200 |
| 1047514 | 2532 | 2551 | 12821 | 12840 | CGGCCTGGTATGACACAGCA | 91 | 201 |
| 1047530 | 2782 | 2801 | 13071 | 13090 | GAGCACCCGGCCTCCAGGCT | 80 | 202 |
| 1047546 | 2864 | 2883 | 13153 | 13172 | CTGGGCACAGATCCCACCAG | 107 | 203 |
| 1047562 | 2927 | 2946 | 13216 | 13235 | GGACCCTTCTTCGGCCTTAG | 69 | 204 |
| 1047578 | 3043 | 3062 | 13332 | 13351 | TTATTTTTCCTCAGCGACTA | 75 | 205 |
| 1047594 | 3062 | 3081 | 13351 | 13370 | AAGGGCGCAGCATTTGTCTT | 86 | 206 |
| 1047610 | N/A | N/A | 8782 | 8801 | GTGAGGCTTTTGAGATATCT | 33 | 207 |
| 1047626 | N/A | N/A | 9038 | 9057 | TCTGCCAGTTTAATGTACAG | 114 | 208 |
| 1047642 | N/A | N/A | 9078 | 9097 | CTGCGCACCCAAGGACTCAC | 96 | 209 |
| 1047658 | N/A | N/A | 9257 | 9276 | CCTGAGGGAAGAATCCTCTG | 86 | 210 |
| 1047674 | N/A | N/A | 8390 | 8409 | CCACGAGGCCCTGCTGTACT | 111 | 211 |
| 1047690 | N/A | N/A | 8461 | 8480 | CCCTGATCCTCAGTCCCAGT | 82 | 212 |
| 1047706 | N/A | N/A | 8534 | 8553 | CCCTGGTATGATAGGCTCTG | 62 | 213 |
| 1047722 | N/A | N/A | 8645 | 8664 | AGGGCAGATGTCAAGCTCTC | 110 | 214 |
| 1047738 | N/A | N/A | 3968 | 3987 | TCCCCTCCTCACTTCTGCCT | 91 | 215 |
| 1047754 | N/A | N/A | 4097 | 4116 | GCAAGGATAGTGCCCCATCA | 94 | 216 |
| 1047770 | N/A | N/A | 4268 | 4287 | CCACAGTCACAAAGCCCAGC | 84 | 217 |
| 1047786 | N/A | N/A | 4325 | 4344 | TCCGCTTCCAACTCCTCCTT | 107 | 218 |
| 1047802 | N/A | N/A | 4362 | 4381 | CCCCAGAATCCAATCTCCCT | 84 | 219 |
| 1047818 | N/A | N/A | 4477 | 4496 | CCACCGCTTCACAGCTGTGC | 77 | 220 |
| 1047834 | N/A | N/A | 4528 | 4547 | GGGATTCCTCTGATCCCAGG | 93 | 221 |

TABLE 4-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047850 | N/A | N/A | 4706 | 4725 | TGCCTTAACTCATTACTAAG | 64 | 222 |
| 1047866 | N/A | N/A | 4809 | 4828 | ACAGAGACCACCCCCACCCA | 63 | 223 |
| 1047882 | N/A | N/A | 4959 | 4978 | CTGACCTGTCTATAGGCAGC | 89* | 224 |
| 1047898 | N/A | N/A | 5085 | 5104 | GCCTTACCCCTCCTTCTGGG | 100 | 225 |
| 1047914 | N/A | N/A | 5268 | 5287 | TGCCCTGGCCTCACCTCCTC | 98 | 226 |
| 1047930 | N/A | N/A | 5401 | 5420 | GTCTTTCATTTCCTGTCTCT | 55 | 227 |
| 1047946 | N/A | N/A | 5562 | 5581 | TCCCGAACCTCCTGACCAGG | 117 | 228 |
| 1047962 | N/A | N/A | 5803 | 5822 | CCAGCTTCCTCCACCCTCCT | 137 | 229 |
| 1047978 | N/A | N/A | 5936 | 5955 | TCAGCTACTACTAATAATAG | 91 | 230 |
| 1047994 | N/A | N/A | 6077 | 6096 | AACTCTACCACTTAGGAGCT | 130 | 231 |
| 1048010 | N/A | N/A | 6148 | 6167 | GTAACCCAAAACAGACTGGC | 85 | 232 |
| 1048026 | N/A | N/A | 6283 | 6302 | CTCCCACACTACATATAAGC | 82 | 233 |
| 1048042 | N/A | N/A | 6331 | 6350 | TGCCTGTCCTGCCTAGCCCA | 72 | 234 |
| 1048058 | N/A | N/A | 6467 | 6486 | TCTGCCACTCACACTCCTCA | 95 | 235 |
| 1048074 | N/A | N/A | 6549 | 6568 | TTCTAATAGCCCTTTCTCCC | 83 | 236 |
| 1048090 | N/A | N/A | 6990 | 7009 | TCAGCAAGCGAATGAATGAA | 157 | 237 |
| 1048106 | N/A | N/A | 7075 | 7094 | GCTGGGACTTTTCCCAACAA | 91 | 238 |
| 1048122 | N/A | N/A | 7449 | 7468 | AGGCCCCGCCTCTAGCCCGG | 110 | 239 |
| 1048138 | N/A | N/A | 7920 | 7939 | TCATCAAACATCTAGTGACT | 91 | 240 |
| 1048154 | N/A | N/A | 8112 | 8131 | TCTATCTGAAGGAAGATGGA | 90 | 241 |
| 1048170 | N/A | N/A | 8329 | 8348 | GTGATCCTGAAAGAAAGCAG | 68 | 242 |
| 1048186 | N/A | N/A | 9375 | 9394 | TTTAGCTCCCCCCTCCCCCC | 126 | 243 |
| 1048202 | N/A | N/A | 9566 | 9585 | TGCTTTAGTGACCTGTGACT | 74 | 244 |
| 1048218 | N/A | N/A | 9614 | 9633 | CTTTCCTGTCCCCTTTCCTC | 134 | 245 |
| 1048234 | N/A | N/A | 9793 | 9812 | AGCCACCAACCAGCCACATG | 83 | 246 |
| 1048250 | N/A | N/A | 10006 | 10025 | CCTGTAATCCCCTTACTCGG | 92 | 247 |
| 1048266 | N/A | N/A | 10652 | 10671 | GCTGCCAGAGTCCTGGCTGC | 81 | 248 |
| 1048282 | N/A | N/A | 10742 | 10761 | CCATCATGAGTATGAGAACC | 88 | 249 |
| 1048298 | N/A | N/A | 10814 | 10833 | GAGGCCTCTCATGGACTTTC | 84 | 250 |
| 1048314 | N/A | N/A | 10953 | 10972 | AGCCAGAGCCTGACTGGGCC | 80 | 251 |
| 1048330 | N/A | N/A | 11080 | 11099 | GGAATTACATTCAGTTTCCT | 72 | 252 |
| 1048346 | N/A | N/A | 11268 | 11287 | CTCCCCATCCCCAACTGTGT | 107 | 253 |
| 1048362 | N/A | N/A | 11331 | 11350 | CGCCAAATCCCCTCTTCCCA | 106 | 254 |
| 1048378 | N/A | N/A | 11492 | 11511 | CCCAGGTCTTACTTTTCTTG | 80 | 255 |

TABLE 5

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047147 | 61 | 80 | 3509 | 3528 | CGTCTCCTCTCCATCCTGCT | 74 | 256 |
| 1047163 | 139 | 158 | 3587 | 3606 | AGACGGCGGCCAGGAGCCAG | 100 | 257 |
| 1047179 | 275 | 294 | 3723 | 3742 | GAGCTCCATCATCTCTGCCC | 116 | 258 |
| 1047195 | 500 | 519 | 3948 | 3967 | CACAGTGGCCAGGTCCTGTG | 70* | 259 |
| 1047211 | 589 | 608 | 5178 | 5197 | AGGGTGGCTTCATCTGCTTC | 37* | 260 |
| 1047227 | 657 | 676 | 5246 | 5265 | GGATCTTCCTCAAGAACCGG | 90 | 261 |
| 1047243 | 823 | 842 | 5709 | 5728 | GAGCGGTACCACTCTTCGGC | 83 | 262 |
| 1047259 | 1054 | 1073 | 7626 | 7645 | TGCCCCTCTTCCTCCAGCCG | 63 | 263 |
| 1047275 | 1254 | 1273 | 10868 | 10887 | GGCCTTCTGACACAGACTTG | 116 | 264 |
| 1047291 | 1311 | 1330 | N/A | N/A | TAATGACCTCTCCATCCCGC | 91 | 265 |
| 1047307 | 1354 | 1373 | 11643 | 11662 | GTCCTGCCTCACATCACATC | 88 | 266 |
| 1047323 | 1524 | 1543 | 11813 | 11832 | CCTGATACTGACGGAGCCTA | 56 | 267 |
| 1047339 | 1633 | 1652 | 11922 | 11941 | CTCCTCATTCTAACGCAAGC | 116 | 268 |
| 1047355 | 1668 | 1687 | 11957 | 11976 | TAGGTGCCCCCGCCCTCCT | 68 | 269 |
| 1047371 | 1754 | 1773 | 12043 | 12062 | ACAGTTCCCAGATACTCCGA | 80 | 270 |
| 1047387 | 1794 | 1813 | 12083 | 12102 | GTCTCAGTTTTCCTCCAGCA | 12 | 271 |
| 1047403 | 1966 | 1985 | 12255 | 12274 | CCAATCTATAATCCCAGCTA | 89 | 272 |
| 1047419 | 2065 | 2084 | 12354 | 12373 | TGGGCAGGTGACTGCCCCAG | 110 | 273 |
| 1047435 | 2192 | 2211 | 12481 | 12500 | CAGATCCCCCAAGTGCTGAG | 87 | 274 |
| 1047451 | 2240 | 2259 | 12529 | 12548 | AGCCCCCTCTATCCCTCCC | 97 | 275 |
| 1047467 | 2335 | 2354 | 12624 | 12643 | TGCCTCCTCCTCCATCTCTA | 72 | 276 |
| 1047483 | 2384 | 2403 | 12673 | 12692 | GCAACTGGTCACCCACAACC | 49 | 277 |
| 1047499 | 2462 | 2481 | 12751 | 12770 | ACATCCCCTTTCTCTCCTGT | 77 | 278 |
| 1047515 | 2675 | 2694 | 12964 | 12983 | TTTGTGTGTGAGTAAGAAGG | 49 | 279 |
| 1047531 | 2785 | 2804 | 13074 | 13093 | CCTGAGCACCCGGCCTCCAG | 80 | 280 |
| 1047547 | 2865 | 2884 | 13154 | 13173 | TCTGGGCACAGATCCCACCA | 85 | 281 |
| 1047563 | 2928 | 2947 | 13217 | 13236 | AGGACCCTTCTTCGGCCTTA | 70 | 282 |
| 1047579 | 3044 | 3063 | 13333 | 13352 | TTTATTTTTCCTCAGCGACT | 47 | 283 |
| 1047611 | N/A | N/A | 8826 | 8845 | TTCCATTTACAATCTGGTGA | 93 | 285 |
| 1047627 | N/A | N/A | 9040 | 9059 | GCTCTGCCAGTTTAATGTAC | 128 | 286 |
| 1047643 | N/A | N/A | 9079 | 9098 | ACTGCGCACCCAAGGACTCA | 77 | 287 |
| 1047659 | N/A | N/A | 9283 | 9302 | ACTTTATTCACTGCAAGAGC | 65 | 288 |
| 1047675 | N/A | N/A | 8398 | 8417 | TGCCCTTCCCACGAGGCCCT | 53 | 289 |
| 1047691 | N/A | N/A | 8462 | 8481 | GCCCTGATCCTCAGTCCCAG | 92 | 290 |
| 1047707 | N/A | N/A | 8535 | 8554 | ACCCTGGTATGATAGGCTCT | 46 | 291 |
| 1047723 | N/A | N/A | 8662 | 8681 | CTCAGGGATCTGCAGACAGG | 81 | 292 |

TABLE 5-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047739 | N/A | N/A | 3969 | 3988 | ATCCCCTCCTCACTTCTGCC | 85* | 293 |
| 1047755 | N/A | N/A | 4119 | 4138 | GTCCCTCCCATCATGTTGGG | 83 | 294 |
| 1047771 | N/A | N/A | 4270 | 4289 | GCCCACAGTCACAAAGCCCA | 68 | 295 |
| 1047787 | N/A | N/A | 4327 | 4346 | TCTCCGCTTCCAACTCCTCC | 109 | 296 |
| 1047803 | N/A | N/A | 4363 | 4382 | ACCCCAGAATCCAATCTCCC | 81 | 297 |
| 1047819 | N/A | N/A | 4503 | 4522 | ACCTTTTGAAATGAATTTTA | 65 | 298 |
| 1047835 | N/A | N/A | 4588 | 4607 | CTCCTGCACTTGAAGGCACA | 101 | 299 |
| 1047851 | N/A | N/A | 4707 | 4726 | TTGCCTTAACTCATTACTAA | 77 | 300 |
| 1047867 | N/A | N/A | 4811 | 4830 | TCACAGAGACCACCCCCACC | 97 | 301 |
| 1047883 | N/A | N/A | 4964 | 4983 | CCTCCCTGACCTGTCTATAG | 103* | 302 |
| 1047899 | N/A | N/A | 5086 | 5105 | TGCCTTACCCCTCCTTCTGG | 76 | 303 |
| 1047915 | N/A | N/A | 5270 | 5289 | TCTGCCCTGGCCTCACCTCC | 102 | 304 |
| 1047931 | N/A | N/A | 5403 | 5422 | TTGTCTTTCATTTCCTGTCT | 67 | 305 |
| 1047947 | N/A | N/A | 5563 | 5582 | TTCCCGAACCTCCTGACCAG | 131 | 306 |
| 1047963 | N/A | N/A | 5804 | 5823 | CCCAGCTTCCTCCACCCTCC | 58 | 307 |
| 1047979 | N/A | N/A | 5937 | 5956 | ATCAGCTACTACTAATAATA | 128 | 308 |
| 1047995 | N/A | N/A | 6078 | 6097 | CAACTCTACCACTTAGGAGC | 97 | 309 |
| 1048011 | N/A | N/A | 6150 | 6169 | CAGTAACCCAAAACAGACTG | 85 | 310 |
| 1048027 | N/A | N/A | 6284 | 6303 | GCTCCCACACTACATATAAG | 48 | 311 |
| 1048043 | N/A | N/A | 6352 | 6371 | CTTCTCTTCCTGTCCACAGC | 93 | 312 |
| 1048059 | N/A | N/A | 6471 | 6490 | GGCTTCTGCCACTCACACTC | 85 | 313 |
| 1048075 | N/A | N/A | 6550 | 6569 | GTTCTAATAGCCCTTTCTCC | 124 | 314 |
| 1048091 | N/A | N/A | 6991 | 7010 | GTCAGCAAGCGAATGAATGA | 85 | 315 |
| 1048107 | N/A | N/A | 7109 | 7128 | CAGCACCCCAGTTAACCCCA | 73 | 316 |
| 1048123 | N/A | N/A | 7450 | 7469 | CAGGCCCCGCCTCTAGCCCG | 88 | 317 |
| 1048139 | N/A | N/A | 7928 | 7947 | CCATTCAGTCATCAAACATC | 76 | 318 |
| 1048155 | N/A | N/A | 8120 | 8139 | GGCGCATGTCTATCTGAAGG | 76 | 319 |
| 1048171 | N/A | N/A | 8330 | 8349 | GGTGATCCTGAAAGAAAGCA | 103 | 320 |
| 1048187 | N/A | N/A | 9391 | 9410 | TGCAAGTAAAAAGTAATTTA | 69 | 321 |
| 1048203 | N/A | N/A | 9568 | 9587 | TGTGCTTTAGTGACCTGTGA | 31 | 322 |
| 1048219 | N/A | N/A | 9619 | 9638 | GGTCCCTTTCCTGTCCCCTT | 53 | 323 |
| 1048235 | N/A | N/A | 9794 | 9813 | TAGCCACCAACCAGCCACAT | 97 | 324 |
| 1048251 | N/A | N/A | 10007 | 10026 | ACCTGTAATCCCCTTACTCG | 89 | 325 |
| 1048267 | N/A | N/A | 10657 | 10676 | GTGCTGCTGCCAGAGTCCTG | 35 | 326 |
| 1048283 | N/A | N/A | 10750 | 10769 | CCCCCTCCCCATCATGAGTA | 100 | 327 |
| 1048299 | N/A | N/A | 10841 | 10860 | GGCTGGTTTCTGCAGATGTG | 87 | 328 |

TABLE 5-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048315 | N/A | N/A | 10954 | 10973 | CAGCCAGAGCCTGACTGGGC | 188 | 329 |
| 1048331 | N/A | N/A | 11086 | 11105 | GGAAACGGAATTACATTCAG | 130 | 330 |
| 1048347 | N/A | N/A | 11269 | 11288 | CCTCCCCATCCCCAACTGTG | 99 | 331 |
| 1048363 | N/A | N/A | 11332 | 11351 | ACGCCAAATCCCCTCTTCCC | 93 | 332 |
| 1048379 | N/A | N/A | 11501 | 11520 | CCCCGACTTCCCAGGTCTTA | 91 | 333 |

TABLE 6

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047148 | 112 | 131 | 3560 | 3579 | ACCATCATCTCCCCTGAGGA | 116 | 334 |
| 1047164 | 150 | 169 | 3598 | 3617 | TGCCAGGACCCAGACGGCGG | 96 | 335 |
| 1047180 | 277 | 296 | 3725 | 3744 | TTGAGCTCCATCATCTCTGC | 123 | 336 |
| 1047196 | 503 | 522 | 3951 | 3970 | CCTCACAGTGGCCAGGTCCT | 27* | 337 |
| 1047212 | 615 | 634 | 5204 | 5223 | TCTTCCTCTCCAGATCCAGA | 77 | 338 |
| 1047228 | 658 | 677 | 5247 | 5266 | TGGATCTTCCTCAAGAACCG | 75 | 339 |
| 1047244 | 824 | 843 | 5710 | 5729 | GGAGCGGTACCACTCTTCGG | 74 | 340 |
| 1047260 | 1058 | 1077 | 7630 | 7649 | GCTCTGCCCCTCTTCCTCCA | 82 | 341 |
| 1047276 | 1255 | 1274 | 10869 | 10888 | TGGCCTTCTGACACAGACTT | 137 | 342 |
| 1047292 | 1312 | 1331 | N/A | N/A | TTAATGACCTCTCCATCCCG | 81 | 343 |
| 1047308 | 1356 | 1375 | 11645 | 11664 | GGGTCCTGCCTCACATCACA | 69 | 344 |
| 1047324 | 1526 | 1545 | 11815 | 11834 | GGCCTGATACTGACGGAGCC | 73 | 345 |
| 1047340 | 1634 | 1653 | 11923 | 11942 | CCTCCTCATTCTAACGCAAG | 63 | 346 |
| 1047356 | 1672 | 1691 | 11961 | 11980 | GTAGTAGGTGCCCCCCGCCC | 84 | 347 |
| 1047372 | 1755 | 1774 | 12044 | 12063 | CACAGTTCCCAGATACTCCG | 49 | 348 |
| 1047388 | 1795 | 1814 | 12084 | 12103 | AGTCTCAGTTTTCCTCCAGC | 24 | 349 |
| 1047404 | 1999 | 2018 | 12288 | 12307 | GGAGAACAACCCTCTGAGCT | 75 | 350 |
| 1047420 | 2101 | 2120 | 12390 | 12409 | CACTTGAGTCATCGCTCAGG | 107 | 351 |
| 1047436 | 2193 | 2212 | 12482 | 12501 | ACAGATCCCCAAGTGCTGA | 73 | 352 |
| 1047452 | 2241 | 2260 | 12530 | 12549 | CAGCCCCCTCTATCCCTCC | 88 | 353 |
| 1047468 | 2337 | 2356 | 12626 | 12645 | ATTGCCTCCTCCTCCATCTC | 93 | 354 |
| 1047484 | 2395 | 2414 | 12684 | 12703 | AGAGGCCAAGTGCAACTGGT | 80 | 355 |
| 1047500 | 2463 | 2482 | 12752 | 12771 | TACATCCCCTTTCTCTCCTG | 47 | 356 |
| 1047516 | 2699 | 2718 | 12988 | 13007 | CACTACCTAGAATACTGGGT | 92 | 357 |
| 1047532 | 2794 | 2813 | 13083 | 13102 | CGTGTCAGCCCTGAGCACCC | 129 | 358 |

TABLE 6-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047548 | 2866 | 2885 | 13155 | 13174 | CTCTGGGCACAGATCCCACC | 141 | 359 |
| 1047564 | 2931 | 2950 | 13220 | 13239 | GGAAGGACCCTTCTTCGGCC | 67 | 360 |
| 1047580 | 3045 | 3064 | 13334 | 13353 | CTTTATTTTTCCTCAGCGAC | 35 | 361 |
| 1047612 | N/A | N/A | 8827 | 8846 | GTTCCATTTACAATCTGGTG | 60 | 363 |
| 1047628 | N/A | N/A | 9053 | 9072 | TTACCACTAACAAGCTCTGC | 76 | 364 |
| 1047644 | N/A | N/A | 9081 | 9100 | CCACTGCGCACCCAAGGACT | 89 | 365 |
| 1047660 | N/A | N/A | 9290 | 9309 | ACATAAAACTTTATTCACTG | 74 | 366 |
| 1047676 | N/A | N/A | 8399 | 8418 | GTGCCCTTCCCACGAGGCCC | 176 | 367 |
| 1047692 | N/A | N/A | 8463 | 8482 | TGCCCTGATCCTCAGTCCCA | 81 | 368 |
| 1047708 | N/A | N/A | 8536 | 8555 | TACCCTGGTATGATAGGCTC | 60 | 369 |
| 1047724 | N/A | N/A | 8669 | 8688 | GTGCTTGCTCAGGGATCTGC | 56 | 370 |
| 1047740 | N/A | N/A | 3971 | 3990 | CCATCCCTCCTCACTTCTG | 85* | 371 |
| 1047756 | N/A | N/A | 4120 | 4139 | GGTCCCTCCCATCATGTTGG | 76 | 372 |
| 1047772 | N/A | N/A | 4272 | 4291 | CTGCCCACAGTCACAAAGCC | 103 | 373 |
| 1047788 | N/A | N/A | 4328 | 4347 | TTCTCCGCTTCCAACTCCTC | 133 | 374 |
| 1047804 | N/A | N/A | 4364 | 4383 | CACCCCAGAATCCAATCTCC | 78 | 375 |
| 1047820 | N/A | N/A | 4507 | 4526 | AACCACCTTTTGAAATGAAT | 118 | 376 |
| 1047836 | N/A | N/A | 4596 | 4615 | CACATGTCCTCCTGCACTTG | 108 | 377 |
| 1047852 | N/A | N/A | 4708 | 4727 | TTTGCCTTAACTCATTACTA | 91 | 378 |
| 1047868 | N/A | N/A | 4812 | 4831 | GTCACAGAGACCACCCCCAC | 108 | 379 |
| 1047884 | N/A | N/A | 4965 | 4984 | ACCTCCCTGACCTGTCTATA | 83 | 380 |
| 1047900 | N/A | N/A | 5087 | 5106 | TTGCCTTACCCCTCCTTCTG | 102 | 381 |
| 1047916 | N/A | N/A | 5282 | 5301 | AGCTTTCCTCCCTCTGCCCT | 92 | 382 |
| 1047932 | N/A | N/A | 5405 | 5424 | GTTTGTCTTTCATTTCCTGT | 82 | 383 |
| 1047948 | N/A | N/A | 5564 | 5583 | GTTCCCGAACCTCCTGACCA | 103 | 384 |
| 1047964 | N/A | N/A | 5805 | 5824 | TCCCAGCTTCCTCCACCCTC | 78 | 385 |
| 1047980 | N/A | N/A | 5938 | 5957 | TATCAGCTACTACTAATAAT | 106 | 386 |
| 1047996 | N/A | N/A | 6079 | 6098 | CCAACTCTACCACTTAGGAG | 96 | 387 |
| 1048012 | N/A | N/A | 6151 | 6170 | TCAGTAACCCAAAACAGACT | 124 | 388 |
| 1048028 | N/A | N/A | 6285 | 6304 | GGCTCCCACACTACATATAA | 134 | 389 |
| 1048044 | N/A | N/A | 6353 | 6372 | TCTTCTCTTCCTGTCCACAG | 93 | 390 |
| 1048060 | N/A | N/A | 6473 | 6492 | GTGGCTTCTGCCACTCACAC | 129 | 391 |
| 1048076 | N/A | N/A | 6556 | 6575 | CCCTGGGTTCTAATAGCCCT | 89 | 392 |
| 1048092 | N/A | N/A | 6993 | 7012 | TGGTCAGCAAGCGAATGAAT | 81 | 393 |
| 1048108 | N/A | N/A | 7111 | 7130 | AGCAGCACCCCAGTTAACCC | 104 | 394 |
| 1048124 | N/A | N/A | 7451 | 7470 | CCAGGCCCCGCCTCTAGCCC | 89 | 395 |

TABLE 6-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048140 | N/A | N/A | 7932 | 7951 | CCATCCATTCAGTCATCAAA | 70 | 396 |
| 1048156 | N/A | N/A | 8142 | 8161 | GGCTTGAGTGTTATCTGGGA | 74 | 397 |
| 1048172 | N/A | N/A | 8332 | 8351 | ATGGTGATCCTGAAAGAAAG | 87 | 398 |
| 1048188 | N/A | N/A | 9392 | 9411 | ATGCAAGTAAAAAGTAATTT | 61 | 399 |
| 1048204 | N/A | N/A | 9581 | 9600 | TCTGCCATTTATCTGTGCTT | 61 | 400 |
| 1048220 | N/A | N/A | 9621 | 9640 | TAGGTCCCTTTCCTGTCCCC | 60 | 401 |
| 1048236 | N/A | N/A | 9795 | 9814 | TTAGCCACCAACCAGCCACA | 106 | 402 |
| 1048252 | N/A | N/A | 10009 | 10028 | GCACCTGTAATCCCCTTACT | 76 | 403 |
| 1048268 | N/A | N/A | 10658 | 10677 | AGTGCTGCTGCCAGAGTCCT | 80 | 404 |
| 1048284 | N/A | N/A | 10751 | 10770 | CCCCCCTCCCCATCATGAGT | 82 | 405 |
| 1048300 | N/A | N/A | 10921 | 10940 | TACCTCTCCATCCCGCATCT | 109 | 406 |
| 1048316 | N/A | N/A | 10976 | 10995 | TGGCCTTGAGAATCCCTGGG | 99 | 407 |
| 1048332 | N/A | N/A | 11090 | 11109 | CTGAGGAAACGGAATTACAT | 83 | 408 |
| 1048348 | N/A | N/A | 11272 | 11291 | AGCCCTCCCCATCCCCAACT | 121 | 409 |
| 1048364 | N/A | N/A | 11333 | 11352 | TACGCCAAATCCCCTCTTCC | 92 | 410 |
| 1048380 | N/A | N/A | 11504 | 11523 | AGTCCCCGACTTCCCAGGTC | 116 | 411 |

TABLE 7

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047149 | 113 | 132 | 3561 | 3580 | CACCATCATCTCCCCTGAGG | 102 | 412 |
| 1047165 | 151 | 170 | 3599 | 3618 | GTGCCAGGACCCAGACGGCG | 120 | 413 |
| 1047181 | 279 | 298 | 3727 | 3746 | CATTGAGCTCCATCATCTCT | 92 | 414 |
| 1047197 | 525 | 544 | N/A | N/A | TGGTTTCATCCTGGAGCTTC | 39* | 415 |
| 1047213 | 617 | 636 | 5206 | 5225 | AATCTTCCTCTCCAGATCCA | 79 | 416 |
| 1047229 | 659 | 678 | 5248 | 5267 | GTGGATCTTCCTCAAGAACC | 83 | 417 |
| 1047245 | 825 | 844 | 5711 | 5730 | TGGAGCGGTACCACTCTTCG | 77 | 418 |
| 1047261 | 1060 | 1079 | 7632 | 7651 | AGGCTCTGCCCCTCTTCCTC | 78 | 419 |
| 1047277 | 1257 | 1276 | 10871 | 10890 | GGTGGCCTTCTGACACAGAC | 98 | 420 |
| 1047293 | 1313 | 1332 | N/A | N/A | CTTAATGACCTCTCCATCCC | 105 | 421 |
| 1047309 | 1357 | 1376 | 11646 | 11665 | TGGGTCCTGCCTCACATCAC | 154 | 422 |
| 1047325 | 1529 | 1548 | 11818 | 11837 | GCAGGCCTGATACTGACGGA | 46 | 423 |
| 1047341 | 1635 | 1654 | 11924 | 11943 | TCCTCCTCATTCTAACGCAA | 53 | 424 |

TABLE 7-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047357 | 1684 | 1703 | 11973 | 11992 | GTGGAGGGCGATGTAGTAGG | 42 | 425 |
| 1047373 | 1756 | 1775 | 12045 | 12064 | GCACAGTTCCCAGATACTCC | 33 | 426 |
| 1047389 | 1812 | 1831 | 12101 | 12120 | CTTCCCTTTCCTGTCTGAGT | 64 | 427 |
| 1047405 | 2003 | 2022 | 12292 | 12311 | TCTAGGAGAACAACCCTCTG | 160 | 428 |
| 1047421 | 2103 | 2122 | 12392 | 12411 | GACACTTGAGTCATCGCTCA | 63 | 429 |
| 1047437 | 2194 | 2213 | 12483 | 12502 | AACAGATCCCCAAGTGCTG | 85 | 430 |
| 1047453 | 2242 | 2261 | 12531 | 12550 | GCAGCCCCCTCTATCCCTC | 173 | 431 |
| 1047469 | 2341 | 2360 | 12630 | 12649 | CCCAATTGCCTCCTCCTCCA | 53 | 432 |
| 1047485 | 2407 | 2426 | 12696 | 12715 | TTCCCACAATCCAGAGGCCA | 101 | 433 |
| 1047501 | 2464 | 2483 | 12753 | 12772 | ATACATCCCCTTTCTCTCCT | 63 | 434 |
| 1047517 | 2701 | 2720 | 12990 | 13009 | GGCACTACCTAGAATACTGG | 73 | 435 |
| 1047533 | 2833 | 2852 | 13122 | 13141 | GTCTGCTCAGTCAAAGCAGA | 93 | 436 |
| 1047549 | 2877 | 2896 | 13166 | 13185 | CCCAGTCCCATCTCTGGGCA | 134 | 437 |
| 1047565 | 2932 | 2951 | 13221 | 13240 | GGGAAGGACCCTTCTTCGGC | 66 | 438 |
| 1047581 | 3046 | 3065 | 13335 | 13354 | TCTTTATTTTCCTCAGCGA | 41 | 439 |
| 1047613 | N/A | N/A | 8828 | 8847 | CGTTCCATTTACAATCTGGT | 47 | 441 |
| 1047629 | N/A | N/A | 9056 | 9075 | CCTTTACCACTAACAAGCTC | 161 | 442 |
| 1047645 | N/A | N/A | 9086 | 9105 | CAGCTCCACTGCGCACCCAA | 85 | 443 |
| 1047661 | N/A | N/A | 9300 | 9319 | AGAGCAGGGAACATAAAACT | 69 | 444 |
| 1047677 | N/A | N/A | 8400 | 8419 | AGTGCCCTTCCCACGAGGCC | 85 | 445 |
| 1047693 | N/A | N/A | 8464 | 8483 | TTGCCCTGATCCTCAGTCCC | 117 | 446 |
| 1047709 | N/A | N/A | 8547 | 8566 | CCACCTAGAAGTACCCTGGT | 75 | 447 |
| 1047725 | N/A | N/A | 8688 | 8707 | GAAAACACTCAGAAGGGCAG | 101 | 448 |
| 1047741 | N/A | N/A | 3972 | 3991 | CCCATCCCCTCCTCACTTCT | 133 | 449 |
| 1047757 | N/A | N/A | 4122 | 4141 | CTGGTCCCTCCCATCATGTT | 136 | 450 |
| 1047773 | N/A | N/A | 4273 | 4292 | GCTGCCCACAGTCACAAAGC | 126 | 451 |
| 1047789 | N/A | N/A | 4334 | 4353 | TCAACCTTCTCCGCTTCCAA | 66 | 452 |
| 1047805 | N/A | N/A | 4369 | 4388 | TTCTTCACCCCAGAATCCAA | 123 | 453 |
| 1047821 | N/A | N/A | 4508 | 4527 | TAACCACCTTTTGAAATGAA | 75 | 454 |
| 1047837 | N/A | N/A | 4657 | 4676 | CTGCTCACACAGGCGCATCC | 97 | 455 |
| 1047853 | N/A | N/A | 4709 | 4728 | TTTTGCCTTAACTCATTACT | 142 | 456 |
| 1047869 | N/A | N/A | 4813 | 4832 | TGTCACAGAGACCACCCCA | 87 | 457 |
| 1047885 | N/A | N/A | 4968 | 4987 | TCCACCTCCCTGACCTGTCT | 84 | 458 |
| 1047901 | N/A | N/A | 5090 | 5109 | GCCTTGCCTTACCCCTCCTT | 86 | 459 |
| 1047917 | N/A | N/A | 5284 | 5303 | TGAGCTTTCCTCCCTCTGCC | 93 | 460 |
| 1047933 | N/A | N/A | 5417 | 5436 | TAGTGTCTTTCTGTTTGTCT | 82 | 461 |

TABLE 7-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047949 | N/A | N/A | 5565 | 5584 | AGTTCCCGAACCTCCTGACC | 74 | 462 |
| 1047965 | N/A | N/A | 5806 | 5825 | CTCCCAGCTTCCTCCACCCT | 101 | 463 |
| 1047981 | N/A | N/A | 5939 | 5958 | GTATCAGCTACTACTAATAA | 137 | 464 |
| 1047997 | N/A | N/A | 6080 | 6099 | TCCAACTCTACCACTTAGGA | 112 | 465 |
| 1048013 | N/A | N/A | 6152 | 6171 | CTCAGTAACCCAAAACAGAC | 79 | 466 |
| 1048029 | N/A | N/A | 6287 | 6306 | CTGGCTCCCACACTACATAT | 86 | 467 |
| 1048045 | N/A | N/A | 6354 | 6373 | TTCTTCTCTTCCTGTCCACA | 92 | 468 |
| 1048061 | N/A | N/A | 6474 | 6493 | AGTGGCTTCTGCCACTCACA | 88 | 469 |
| 1048077 | N/A | N/A | 6557 | 6576 | ACCCTGGGTTCTAATAGCCC | 104 | 470 |
| 1048093 | N/A | N/A | 7008 | 7027 | ACCTAGCACAACACCTGGTC | 77 | 471 |
| 1048109 | N/A | N/A | 7318 | 7337 | GCGCTCACCGTGCCGCGCAG | 85 | 472 |
| 1048125 | N/A | N/A | 7497 | 7516 | GAGCCCCGACCCGACTTGGG | 55 | 473 |
| 1048141 | N/A | N/A | 7943 | 7962 | GTTGAATCCATCCATCCATT | 73 | 474 |
| 1048157 | N/A | N/A | 8195 | 8214 | AGCTTTTTCCCCAGCAGCCA | 91 | 475 |
| 1048173 | N/A | N/A | 8333 | 8352 | AATGGTGATCCTGAAAGAAA | 80 | 476 |
| 1048189 | N/A | N/A | 9415 | 9434 | AGCTAAGAATCATTTCAGGG | 77 | 477 |
| 1048205 | N/A | N/A | 9584 | 9603 | CTCTCTGCCATTTATCTGTG | 67 | 478 |
| 1048221 | N/A | N/A | 9622 | 9641 | ATAGGTCCCTTTCCTGTCCC | 67 | 479 |
| 1048237 | N/A | N/A | 9796 | 9815 | CTTAGCCACCAACCAGCCAC | 123 | 480 |
| 1048253 | N/A | N/A | 10010 | 10029 | CGCACCTGTAATCCCCTTAC | 97 | 481 |
| 1048269 | N/A | N/A | 10666 | 10685 | ATCCCAATAGTGCTGCTGCC | 79 | 482 |
| 1048285 | N/A | N/A | 10755 | 10774 | CGCACCCCCCTCCCCATCAT | 109 | 483 |
| 1048301 | N/A | N/A | 10925 | 10944 | TCCTTACCTCTCCATCCCGC | 106 | 484 |
| 1048317 | N/A | N/A | 10993 | 11012 | GGCTTTCCTCCATGGCCTGG | 93 | 485 |
| 1048333 | N/A | N/A | 11092 | 11111 | GACTGAGGAAACGGAATTAC | 86 | 486 |
| 1048349 | N/A | N/A | 11278 | 11297 | ATGGAAAGCCCTCCCCATCC | 86 | 487 |
| 1048365 | N/A | N/A | 11334 | 11353 | ATACGCCAAATCCCCTCTTC | 105 | 488 |
| 1048381 | N/A | N/A | 11505 | 11524 | AAGTCCCCGACTTCCCAGGT | 79 | 489 |

TABLE 8

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047150 | 115 | 134 | 3563 | 3582 | CCCACCATCATCTCCCCTGA | 93 | 490 |
| 1047166 | 156 | 175 | 3604 | 3623 | GGCGGGTGCCAGGACCCAGA | 79 | 491 |

TABLE 8-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047182 | 358 | 377 | 3806 | 3825 | AGCTGGTTCAGCTCAGCAGC | 114 | 492 |
| 1047198 | 528 | 547 | 4913 | 4932 | GGTTGGTTTCATCCTGGAGC | 19* | 493 |
| 1047214 | 619 | 638 | 5208 | 5227 | TCAATCTTCCTCTCCAGATC | 115 | 494 |
| 1047230 | 680 | 699 | N/A | N/A | GAGTTCCCGAACCTCCTCCT | 85 | 495 |
| 1047246 | 838 | 857 | N/A | N/A | AGGTCTGCAAACTTGGAGCG | 90 | 496 |
| 1047262 | 1064 | 1083 | 7636 | 7655 | CTTGAGGCTCTGCCCCTCTT | 88 | 497 |
| 1047278 | 1258 | 1277 | 10872 | 10891 | AGGTGGCCTTCTGACACAGA | 94 | 498 |
| 1047294 | 1314 | 1333 | N/A | N/A | CCTTAATGACCTCTCCATCC | 154 | 499 |
| 1047310 | 1358 | 1377 | 11647 | 11666 | GTGGGTCCTGCCTCACATCA | 88 | 500 |
| 1047326 | 1530 | 1549 | 11819 | 11838 | GGCAGGCCTGATACTGACGG | 103 | 501 |
| 1047342 | 1636 | 1655 | 11925 | 11944 | TTCCTCCTCATTCTAACGCA | 66 | 502 |
| 1047358 | 1685 | 1704 | 11974 | 11993 | TGTGGAGGGCGATGTAGTAG | 50 | 503 |
| 1047374 | 1757 | 1776 | 12046 | 12065 | GGCACAGTTCCCAGATACTC | 40 | 504 |
| 1047390 | 1813 | 1832 | 12102 | 12121 | CCTTCCCTTTCCTGTCTGAG | 81 | 505 |
| 1047406 | 2004 | 2023 | 12293 | 12312 | GTCTAGGAGAACAACCCTCT | 96 | 506 |
| 1047422 | 2112 | 2131 | 12401 | 12420 | GTGGACTGAGACACTTGAGT | 54 | 507 |
| 1047438 | 2201 | 2220 | 12490 | 12509 | CGTACACAACAGATCCCCCA | 61 | 508 |
| 1047454 | 2243 | 2262 | 12532 | 12551 | GGCAGCCCCCTCTATCCCT | 57 | 509 |
| 1047470 | 2342 | 2361 | 12631 | 12650 | TCCCAATTGCCTCCTCCTCC | 66 | 510 |
| 1047486 | 2413 | 2432 | 12702 | 12721 | CCTTAATTCCCACAATCCAG | 147 | 511 |
| 1047502 | 2465 | 2484 | 12754 | 12773 | GATACATCCCCTTTCTCTCC | 67 | 512 |
| 1047518 | 2702 | 2721 | 12991 | 13010 | GGGCACTACCTAGAATACTG | 43 | 513 |
| 1047534 | 2843 | 2862 | 13132 | 13151 | CTGCTCACCAGTCTGCTCAG | 97 | 514 |
| 1047550 | 2878 | 2897 | 13167 | 13186 | TCCCAGTCCCATCTCTGGGC | 106 | 515 |
| 1047566 | 2933 | 2952 | 13222 | 13241 | AGGGAAGGACCCTTCTTCGG | 71 | 516 |
| 1047582 | 3047 | 3066 | 13336 | 13355 | GTCTTTATTTTCCTCAGCG | 9 | 517 |
| 1047614 | N/A | N/A | 8850 | 8869 | GCAGCTAACCGCGAGCCGGC | 132 | 519 |
| 1047630 | N/A | N/A | 9057 | 9076 | ACCTTTACCACTAACAAGCT | 89 | 520 |
| 1047646 | N/A | N/A | 9088 | 9107 | AGCAGCTCCACTGCGCACCC | 116 | 521 |
| 1047662 | N/A | N/A | 9311 | 9330 | ATTAACATTAAGAGCAGGG | 45 | 522 |
| 1047678 | N/A | N/A | 8401 | 8420 | CAGTGCCCTTCCCACGAGGC | 110 | 523 |
| 1047694 | N/A | N/A | 8467 | 8486 | CCTTTGCCCTGATCCTCAGT | 77 | 524 |
| 1047710 | N/A | N/A | 8549 | 8568 | CCCCACCTAGAAGTACCCTG | 99 | 525 |
| 1047726 | N/A | N/A | 8689 | 8708 | AGAAAACACTCAGAAGGGCA | 169 | 526 |
| 1047742 | N/A | N/A | 3973 | 3992 | CCCCATCCCCTCCTCACTTC | 100 | 527 |
| 1047758 | N/A | N/A | 4124 | 4143 | TTCTGGTCCCTCCCATCATG | 77 | 528 |

TABLE 8-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047774 | N/A | N/A | 4277 | 4296 | GCTCGCTGCCCACAGTCACA | 123 | 529 |
| 1047790 | N/A | N/A | 4338 | 4357 | GACATCAACCTTCTCCGCTT | 67 | 530 |
| 1047806 | N/A | N/A | 4375 | 4394 | CTCACTTTCTTCACCCCAGA | 156 | 531 |
| 1047822 | N/A | N/A | 4510 | 4529 | GGTAACCACCTTTTGAAATG | 91 | 532 |
| 1047838 | N/A | N/A | 4659 | 4678 | TTCTGCTCACACAGGCGCAT | 148 | 533 |
| 1047854 | N/A | N/A | 4712 | 4731 | GGCTTTTGCCTTAACTCATT | 72 | 534 |
| 1047870 | N/A | N/A | 4815 | 4834 | GCTGTCACAGAGACCACCCC | 93 | 535 |
| 1047886 | N/A | N/A | 4971 | 4990 | CCCTCCACCTCCCTGACCTG | 59 | 536 |
| 1047902 | N/A | N/A | 5092 | 5111 | CAGCCTTGCCTTACCCCTCC | 70 | 537 |
| 1047918 | N/A | N/A | 5285 | 5304 | TTGAGCTTTCCTCCCTCTGC | 80 | 538 |
| 1047934 | N/A | N/A | 5429 | 5448 | TTCCGTCTCCCTTAGTGTCT | 105 | 539 |
| 1047950 | N/A | N/A | 5566 | 5585 | GAGTTCCCGAACCTCCTGAC | 70 | 540 |
| 1047966 | N/A | N/A | 5813 | 5832 | GGATATTCTCCCAGCTTCCT | 90 | 541 |
| 1047982 | N/A | N/A | 5945 | 5964 | AGAACAGTATCAGCTACTAC | 106 | 542 |
| 1047998 | N/A | N/A | 6085 | 6104 | GGAAATCCAACTCTACCACT | 106 | 543 |
| 1048014 | N/A | N/A | 6153 | 6172 | GCTCAGTAACCCAAAACAGA | 96 | 544 |
| 1048030 | N/A | N/A | 6288 | 6307 | CCTGGCTCCCACACTACATA | 116 | 545 |
| 1048046 | N/A | N/A | 6356 | 6375 | CCTTCTTCTCTTCCTGTCCA | 133 | 546 |
| 1048062 | N/A | N/A | 6486 | 6505 | TGCTCAGACACCAGTGGCTT | 109 | 547 |
| 1048078 | N/A | N/A | 6567 | 6586 | GCCTGGCCTCACCCTGGGTT | 88 | 548 |
| 1048094 | N/A | N/A | 7023 | 7042 | CTGCCAGACCTCAGCACCTA | 81 | 549 |
| 1048110 | N/A | N/A | 7322 | 7341 | GGCCGCGCTCACCGTGCCGC | 109 | 550 |
| 1048126 | N/A | N/A | 7498 | 7517 | GGAGCCCCGACCCGACTTGG | 124 | 551 |
| 1048142 | N/A | N/A | 7944 | 7963 | GGTTGAATCCATCCATCCAT | 105 | 552 |
| 1048158 | N/A | N/A | 8196 | 8215 | TAGCTTTTCCCCAGCAGCC | 89 | 553 |
| 1048174 | N/A | N/A | 8334 | 8353 | GAATGGTGATCCTGAAAGAA | 81 | 554 |
| 1048190 | N/A | N/A | 9462 | 9481 | AGTGGTCCTAAATATTCTAG | 66 | 555 |
| 1048206 | N/A | N/A | 9585 | 9604 | TCTCTCTGCCATTTATCTGT | 91 | 556 |
| 1048222 | N/A | N/A | 9623 | 9642 | CATAGGTCCCTTTCCTGTCC | 71 | 557 |
| 1048238 | N/A | N/A | 9799 | 9818 | CAACTTAGCCACCAACCAGC | 120 | 558 |
| 1048254 | N/A | N/A | 10576 | 10595 | GGCTTTCTGAAAACCCAGCA | 72 | 559 |
| 1048270 | N/A | N/A | 10673 | 10692 | CCCCCAAATCCCAATAGTGC | 117 | 560 |
| 1048286 | N/A | N/A | 10756 | 10775 | TCGCACCCCCCTCCCCATCA | 106 | 561 |
| 1048302 | N/A | N/A | 10926 | 10945 | CTCCTTACCTCTCCATCCCG | 120 | 562 |
| 1048318 | N/A | N/A | 10994 | 11013 | AGGCTTTCCTCCATGGCCTG | 91 | 563 |
| 1048334 | N/A | N/A | 11110 | 11129 | TAGAACAGCCTATGGAGGGA | 52 | 564 |

TABLE 8-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048350 | N/A | N/A | 11300 | 11319 | GTTTCCTTTTACCAAGCTGG | 34 | 565 |
| 1048366 | N/A | N/A | 11335 | 11354 | GATACGCCAAATCCCCTCTT | 94 | 566 |
| 1048382 | N/A | N/A | 11508 | 11527 | GGGAAGTCCCCGACTTCCCA | 92 | 567 |

TABLE 9

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047151 | 116 | 135 | 3564 | 3583 | CCCCACCATCATCTCCCCTG | 89 | 568 |
| 1047167 | 173 | 192 | 3621 | 3640 | CATTCGAGCCAGGGAGAGGC | 82 | 569 |
| 1047183 | 372 | 391 | 3820 | 3839 | GCTCCTTGGCCCGCAGCTGG | 147 | 570 |
| 1047199 | 529 | 548 | 4914 | 4933 | AGGTTGGTTTCATCCTGGAG | 47* | 571 |
| 1047215 | 620 | 639 | 5209 | 5228 | CTCAATCTTCCTCTCCAGAT | 93 | 572 |
| 1047231 | 683 | 702 | 5569 | 5588 | CTGGAGTTCCCGAACCTCCT | 113 | 573 |
| 1047247 | 943 | 962 | 7300 | 7319 | AGAGACTCCAGGTCGCAGGT | 104 | 574 |
| 1047263 | 1098 | 1117 | 7670 | 7689 | CCTGGTACTCCTGCAAGTGG | 139 | 575 |
| 1047279 | 1260 | 1279 | 10874 | 10893 | TGAGGTGGCCTTCTGACACA | 106 | 576 |
| 1047295 | 1319 | 1338 | N/A | N/A | GGACTCCTTAATGACCTCTC | 77 | 577 |
| 1047311 | 1370 | 1389 | 11659 | 11678 | AGAGGCCACCAGGTGGGTCC | 88 | 578 |
| 1047327 | 1531 | 1550 | 11820 | 11839 | TGGCAGGCCTGATACTGACG | 71 | 579 |
| 1047343 | 1637 | 1656 | 11926 | 11945 | CTTCCTCCTCATTCTAACGC | 68 | 580 |
| 1047359 | 1714 | 1733 | 12003 | 12022 | ACAGTTTCCATAACAACAGG | 137 | 581 |
| 1047375 | 1760 | 1779 | 12049 | 12068 | AAAGGCACAGTTCCCAGATA | 106 | 582 |
| 1047391 | 1814 | 1833 | 12103 | 12122 | GCCTTCCCTTTCCTGTCTGA | 34 | 583 |
| 1047407 | 2005 | 2024 | 12294 | 12313 | AGTCTAGGAGAACAACCCTC | 113 | 584 |
| 1047423 | 2138 | 2157 | 12427 | 12446 | GATGGCATCCCTGGATGGCA | 113 | 585 |
| 1047439 | 2219 | 2238 | 12508 | 12527 | GCACCTCATCCCTCTCCACG | 75 | 586 |
| 1047455 | 2244 | 2263 | 12533 | 12552 | AGGCAGCCCCCCTCTATCCC | 77 | 587 |
| 1047471 | 2343 | 2362 | 12632 | 12651 | ATCCCAATTGCCTCCTCCTC | 96 | 588 |
| 1047487 | 2414 | 2433 | 12703 | 12722 | TCCTTAATTCCCACAATCCA | 105 | 589 |
| 1047503 | 2466 | 2485 | 12755 | 12774 | GGATACATCCCCTTTCTCTC | 48 | 590 |
| 1047519 | 2727 | 2746 | 13016 | 13035 | GCCTCAGTTTTACAATTGTA | 90 | 591 |
| 1047535 | 2844 | 2863 | 13133 | 13152 | TCTGCTCACCAGTCTGCTCA | 92 | 592 |
| 1047551 | 2880 | 2899 | 13169 | 13188 | CCTCCCAGTCCCATCTCTGG | 90 | 593 |

TABLE 9-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047567 | 2937 | 2956 | 13226 | 13245 | GGAGAGGGAAGGACCCTTCT | 105 | 594 |
| 1047583 | 3048 | 3067 | 13337 | 13356 | TGTCTTTATTTTTCCTCAGC | 10 | 595 |
| 1047615 | N/A | N/A | 8851 | 8870 | GGCAGCTAACCGCGAGCCGG | 92 | 597 |
| 1047631 | N/A | N/A | 9058 | 9077 | CACCTTTACCACTAACAAGC | 105 | 598 |
| 1047647 | N/A | N/A | 9089 | 9108 | GAGCAGCTCCACTGCGCACC | 87 | 599 |
| 1047663 | N/A | N/A | 9312 | 9331 | TATTTAACATTAAGAGCAGG | 106 | 600 |
| 1047679 | N/A | N/A | 8402 | 8421 | CCAGTGCCCTTCCCACGAGG | 78 | 601 |
| 1047695 | N/A | N/A | 8469 | 8488 | TCCCTTTGCCCTGATCCTCA | 74 | 602 |
| 1047711 | N/A | N/A | 8551 | 8570 | AGCCCCACCTAGAAGTACCC | 86 | 603 |
| 1047727 | N/A | N/A | 8690 | 8709 | CAGAAAACACTCAGAAGGGC | 93 | 604 |
| 1047743 | N/A | N/A | 3974 | 3993 | TCCCCATCCCCTCCTCACTT | 92 | 605 |
| 1047759 | N/A | N/A | 4126 | 4145 | GTTTCTGGTCCCTCCCATCA | 98 | 606 |
| 1047775 | N/A | N/A | 4278 | 4297 | AGCTCGCTGCCCACAGTCAC | 170 | 607 |
| 1047791 | N/A | N/A | 4339 | 4358 | GGACATCAACCTTCTCCGCT | 98 | 608 |
| 1047807 | N/A | N/A | 4376 | 4395 | CCTCACTTTCTTCACCCCAG | 104 | 609 |
| 1047823 | N/A | N/A | 4512 | 4531 | CAGGTAACCACCTTTTGAAA | 82 | 610 |
| 1047839 | N/A | N/A | 4661 | 4680 | GCTTCTGCTCACACAGGCGC | 96 | 611 |
| 1047855 | N/A | N/A | 4713 | 4732 | GGGCTTTTGCCTTAACTCAT | 89 | 612 |
| 1047871 | N/A | N/A | 4833 | 4852 | TCAGTCTCCCTTGAGGCAGC | 87 | 613 |
| 1047887 | N/A | N/A | 4972 | 4991 | CCCCTCCACCTCCCTGACCT | 109 | 614 |
| 1047903 | N/A | N/A | 5093 | 5112 | TCAGCCTTGCCTTACCCCTC | 96 | 615 |
| 1047919 | N/A | N/A | 5286 | 5305 | GTTGAGCTTTCCTCCCTCTG | 82 | 616 |
| 1047935 | N/A | N/A | 5434 | 5453 | TCTCTTTCCGTCTCCCTTAG | 83 | 617 |
| 1047951 | N/A | N/A | 5724 | 5743 | GGCAGGGCTACCTTGGAGCG | 98 | 618 |
| 1047967 | N/A | N/A | 5814 | 5833 | AGGATATTCTCCCAGCTTCC | 74 | 619 |
| 1047983 | N/A | N/A | 5946 | 5965 | CAGAACAGTATCAGCTACTA | 76 | 620 |
| 1047999 | N/A | N/A | 6086 | 6105 | TGGAAATCCAACTCTACCAC | 122 | 621 |
| 1048015 | N/A | N/A | 6154 | 6173 | GGCTCAGTAACCCAAAACAG | 82 | 622 |
| 1048031 | N/A | N/A | 6290 | 6309 | TTCCTGGCTCCCACACTACA | 106 | 623 |
| 1048047 | N/A | N/A | 6362 | 6381 | GCCCTCCCTTCTTCTCTTCC | 84 | 624 |
| 1048063 | N/A | N/A | 6487 | 6506 | CTGCTCAGACACCAGTGGCT | 111 | 625 |
| 1048079 | N/A | N/A | 6569 | 6588 | TCGCCTGGCCTCACCCTGGG | 101 | 626 |
| 1048095 | N/A | N/A | 7024 | 7043 | GCTGCCAGACCTCAGCACCT | 192 | 627 |
| 1048111 | N/A | N/A | 7328 | 7347 | TGCCCTGGCCGCGCTCACCG | 82 | 628 |
| 1048127 | N/A | N/A | 7502 | 7521 | CCGCGGAGCCCGACCCGAC | 90 | 629 |
| 1048143 | N/A | N/A | 7945 | 7964 | TGGTTGAATCCATCCATCCA | 117 | 630 |

TABLE 9-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048159 | N/A | N/A | 8197 | 8216 | CTAGCTTTTTCCCCAGCAGC | 100 | 631 |
| 1048175 | N/A | N/A | 9316 | 9335 | CTAATATTTAACATTAAGAG | 128 | 632 |
| 1048191 | N/A | N/A | 9463 | 9482 | TAGTGGTCCTAAATATTCTA | 106 | 633 |
| 1048207 | N/A | N/A | 9586 | 9605 | TTCTCTCTGCCATTTATCTG | 70 | 634 |
| 1048223 | N/A | N/A | 9625 | 9644 | CACATAGGTCCCTTTCCTGT | 74 | 635 |
| 1048239 | N/A | N/A | 9800 | 9819 | CCAACTTAGCCACCAACCAG | 96 | 636 |
| 1048255 | N/A | N/A | 10577 | 10596 | TGGCTTTCTGAAAACCCAGC | 83 | 637 |
| 1048271 | N/A | N/A | 10674 | 10693 | GCCCCCAAATCCCAATAGTG | 116 | 638 |
| 1048287 | N/A | N/A | 10757 | 10776 | ATCGCACCCCCTCCCCATC | 142 | 639 |
| 1048303 | N/A | N/A | 10928 | 10947 | CCCTCCTTACCTCTCCATCC | 117 | 640 |
| 1048319 | N/A | N/A | 10996 | 11015 | CCAGGCTTTCCTCCATGGCC | 88 | 641 |
| 1048335 | N/A | N/A | 11111 | 11130 | TTAGAACAGCCTATGGAGGG | 115 | 642 |
| 1048351 | N/A | N/A | 11301 | 11320 | AGTTTCCTTTTACCAAGCTG | 54 | 643 |
| 1048367 | N/A | N/A | 11337 | 11356 | CGGATACGCCAAATCCCCTC | 101 | 644 |
| 1048383 | N/A | N/A | 11539 | 11558 | CAGGTCCACCACCACGAGGC | 138 | 645 |

TABLE 10

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047152 | 117 | 136 | 3565 | 3584 | CCCCCACCATCATCTCCCCT | 104 | 646 |
| 1047168 | 175 | 194 | 3623 | 3642 | GGCATTCGAGCCAGGGAGAG | 90 | 647 |
| 1047184 | 435 | 454 | 3883 | 3902 | GTTGATCGAGCCGCAGCCGC | 104 | 648 |
| 1047200 | 530 | 549 | 4915 | 4934 | CAGGTTGGTTTCATCCTGGA | 56* | 649 |
| 1047216 | 621 | 640 | 5210 | 5229 | ACTCAATCTTCCTCTCCAGA | 95 | 650 |
| 1047232 | 684 | 703 | 5570 | 5589 | CCTGGAGTTCCCGAACCTCC | 126 | 651 |
| 1047248 | 946 | 965 | 7303 | 7322 | CGCAGAGACTCCAGGTCGCA | 104 | 652 |
| 1047264 | 1100 | 1119 | 7672 | 7691 | GTCCTGGTACTCCTGCAAGT | 89 | 653 |
| 1047280 | 1273 | 1292 | 10887 | 10906 | ACGATGTTCCTCTTGAGGTG | 96 | 654 |
| 1047296 | 1320 | 1339 | N/A | N/A | TGGACTCCTTAATGACCTCT | 101 | 655 |
| 1047312 | 1372 | 1391 | 11661 | 11680 | GCAGAGGCCACCAGGTGGGT | 64 | 656 |
| 1047328 | 1580 | 1599 | 11869 | 11888 | GGTGAGTTTCTTGTTAGTTG | 29 | 657 |
| 1047344 | 1638 | 1657 | 11927 | 11946 | CCTTCCTCCTCATTCTAACG | 73 | 658 |
| 1047360 | 1715 | 1734 | 12004 | 12023 | AACAGTTTCCATAACAACAG | 115 | 659 |
| 1047376 | 1761 | 1780 | 12050 | 12069 | CAAAGGCACAGTTCCCAGAT | 94 | 660 |

TABLE 10-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047392 | 1815 | 1834 | 12104 | 12123 | GGCCTTCCCTTTCCTGTCTG | 104 | 661 |
| 1047408 | 2021 | 2040 | 12310 | 12329 | TAGACTGATCAGGGTCAGTC | 125 | 662 |
| 1047424 | 2148 | 2167 | 12437 | 12456 | CGTGCCCACAGATGGCATCC | 87 | 663 |
| 1047440 | 2222 | 2241 | 12511 | 12530 | CCAGCACCTCATCCCTCTCC | 111 | 664 |
| 1047456 | 2246 | 2265 | 12535 | 12554 | CCAGGCAGCCCCCCTCTATC | 87 | 665 |
| 1047472 | 2345 | 2364 | 12634 | 12653 | CCATCCCAATTGCCTCCTCC | 76 | 666 |
| 1047488 | 2417 | 2436 | 12706 | 12725 | ACTTCCTTAATTCCCACAAT | 103 | 667 |
| 1047504 | 2468 | 2487 | 12757 | 12776 | ATGGATACATCCCCTTTCTC | 73 | 668 |
| 1047520 | 2728 | 2747 | 13017 | 13036 | TGCCTCAGTTTTACAATTGT | 109 | 669 |
| 1047536 | 2845 | 2864 | 13134 | 13153 | GTCTGCTCACCAGTCTGCTC | 110 | 670 |
| 1047552 | 2883 | 2902 | 13172 | 13191 | GGCCCTCCCAGTCCCATCTC | 85 | 671 |
| 1047568 | 2956 | 2975 | 13245 | 13264 | AAAGGACACCAAGTCTTGGG | 69 | 672 |
| 1047584 | 3049 | 3068 | 13338 | 13357 | TTGTCTTTATTTTTCCTCAG | 11 | 673 |
| 1047616 | N/A | N/A | 8852 | 8871 | AGGCAGCTAACCGCGAGCCG | 94 | 675 |
| 1047632 | N/A | N/A | 9059 | 9078 | CCACCTTTACCACTAACAAG | 89 | 676 |
| 1047648 | N/A | N/A | 9101 | 9120 | TCAGAGGCCCCAGAGCAGCT | 86 | 677 |
| 1047664 | N/A | N/A | 9314 | 9333 | AATATTTAACATTAAGAGCA | 105 | 678 |
| 1047680 | N/A | N/A | 8404 | 8423 | CTCCAGTGCCCTTCCCACGA | 86 | 679 |
| 1047696 | N/A | N/A | 8471 | 8490 | GATCCCTTTGCCCTGATCCT | 76 | 680 |
| 1047712 | N/A | N/A | 8554 | 8573 | GCAAGCCCCACCTAGAAGTA | 76 | 681 |
| 1047728 | N/A | N/A | 8691 | 8710 | ACAGAAAACACTCAGAAGGG | 92 | 682 |
| 1047744 | N/A | N/A | 3984 | 4003 | AGGCCCCCTTCCCCATCCC | 79 | 683 |
| 1047760 | N/A | N/A | 4138 | 4157 | GGCCCTGGGCCTGTTTCTGG | 86 | 684 |
| 1047776 | N/A | N/A | 4279 | 4298 | GAGCTCGCTGCCCACAGTCA | 119 | 685 |
| 1047792 | N/A | N/A | 4340 | 4359 | TGGACATCAACCTTCTCCGC | 102 | 686 |
| 1047808 | N/A | N/A | 4377 | 4396 | CCCTCACTTTCTTCACCCCA | 71 | 687 |
| 1047824 | N/A | N/A | 4513 | 4532 | CCAGGTAACCACCTTTTGAA | 104 | 688 |
| 1047840 | N/A | N/A | 4686 | 4705 | GTGCCTTATCAGGGTTGGTG | 64 | 689 |
| 1047856 | N/A | N/A | 4714 | 4733 | TGGGCTTTTGCCTTAACTCA | 79 | 690 |
| 1047872 | N/A | N/A | 4835 | 4854 | CCTCAGTCTCCCTTGAGGCA | 104 | 691 |
| 1047888 | N/A | N/A | 4976 | 4995 | CCCTCCCCTCCACCTCCCTG | 79 | 692 |
| 1047904 | N/A | N/A | 5094 | 5113 | CTCAGCCTTGCCTTACCCCT | 121 | 693 |
| 1047920 | N/A | N/A | 5313 | 5332 | TCTCCCTCTCTCAGTTGCAA | 80 | 694 |
| 1047936 | N/A | N/A | 5436 | 5455 | TGTCTCTTTCCGTCTCCCTT | 76 | 695 |
| 1047952 | N/A | N/A | 5738 | 5757 | CAGGCTGGCCCACAGGCAGG | 96 | 696 |
| 1047968 | N/A | N/A | 5815 | 5834 | GAGGATATTCTCCCAGCTTC | 83 | 697 |

TABLE 10-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047984 | N/A | N/A | 5993 | 6012 | CACCTACTTCATAGTAAGGT | 144 | 698 |
| 1048000 | N/A | N/A | 6088 | 6107 | GTTGGAAATCCAACTCTACC | 75 | 699 |
| 1048016 | N/A | N/A | 6155 | 6174 | AGGCTCAGTAACCCAAAACA | 97 | 700 |
| 1048032 | N/A | N/A | 6298 | 6317 | CAGTGTCTTTCCTGGCTCCC | 72 | 701 |
| 1048048 | N/A | N/A | 6363 | 6382 | GGCCCTCCCTTCTTCTCTTC | 106 | 702 |
| 1048064 | N/A | N/A | 6491 | 6510 | CACCCTGCTCAGACACCAGT | 112 | 703 |
| 1048080 | N/A | N/A | 6570 | 6589 | CTCGCCTGGCCTCACCCTGG | 80 | 704 |
| 1048096 | N/A | N/A | 7028 | 7047 | GCGGGCTGCCAGACCTCAGC | 82 | 705 |
| 1048112 | N/A | N/A | 7335 | 7354 | CCCGTCCTGCCCTGGCCGCG | 92 | 706 |
| 1048128 | N/A | N/A | 7833 | 7852 | AAAAAGACTCAGTCCCTGAA | 103 | 707 |
| 1048144 | N/A | N/A | 7946 | 7965 | TTGGTTGAATCCATCCATCC | 68 | 708 |
| 1048160 | N/A | N/A | 8198 | 8217 | CCTAGCTTTTCCCCAGCAG | 71 | 709 |
| 1048176 | N/A | N/A | 9317 | 9336 | ACTAATATTTAACATTAAGA | 69 | 710 |
| 1048192 | N/A | N/A | 9465 | 9484 | TCTAGTGGTCCTAAATATTC | 108 | 711 |
| 1048208 | N/A | N/A | 9593 | 9612 | TTCCTACTTCTCTCTGCCAT | 80 | 712 |
| 1048224 | N/A | N/A | 9633 | 9652 | GCTCAATACACATAGGTCCC | 82 | 713 |
| 1048240 | N/A | N/A | 9801 | 9820 | CCCAACTTAGCCACCAACCA | 120 | 714 |
| 1048256 | N/A | N/A | 10578 | 10597 | CTGGCTTTCTGAAAACCCAG | 119 | 715 |
| 1048272 | N/A | N/A | 10675 | 10694 | AGCCCCCAAATCCCAATAGT | 116 | 716 |
| 1048288 | N/A | N/A | 10759 | 10778 | CCATCGCACCCCCCTCCCCA | 88 | 717 |
| 1048304 | N/A | N/A | 10929 | 10948 | TCCCTCCTTACCTCTCCATC | 73 | 718 |
| 1048320 | N/A | N/A | 10997 | 11016 | CCCAGGCTTTCCTCCATGGC | 113 | 719 |
| 1048336 | N/A | N/A | 11112 | 11131 | CTTAGAACAGCCTATGGAGG | 74 | 720 |
| 1048352 | N/A | N/A | 11302 | 11321 | TAGTTTCCTTTTACCAAGCT | 97 | 721 |
| 1048368 | N/A | N/A | 11338 | 11357 | GCGGATACGCCAAATCCCCT | 74 | 722 |
| 1048384 | N/A | N/A | 11541 | 11560 | CCCAGGTCCACCACCACGAG | 105 | 723 |

TABLE 11

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047153 | 119 | 138 | 3567 | 3586 | GCCCCCCACCATCATCTCCC | 88 | 724 |
| 1047169 | 210 | 229 | 3658 | 3677 | CCAGGGAGAAATCCACCCGG | 81 | 725 |
| 1047185 | 440 | 459 | 3888 | 3907 | GGTGAGTTGATCGAGCCGCA | 70 | 726 |

TABLE 11-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047201 | 539 | 558 | 4924 | 4943 | TTCCAGCCTCAGGTTGGTTT | 29* | 727 |
| 1047217 | 627 | 646 | 5216 | 5235 | CCAGCGACTCAATCTTCCTC | 99 | 728 |
| 1047233 | 703 | 722 | 5589 | 5608 | TGCTGTCGGGCCAGCTGCTC | 118 | 729 |
| 1047249 | 990 | 1009 | 7562 | 7581 | CCTCCTGCTCGCGCATCTGC | 93 | 730 |
| 1047265 | 1101 | 1120 | 7673 | 7692 | GGTCCTGGTACTCCTGCAAG | 129 | 731 |
| 1047281 | 1274 | 1293 | 10888 | 10907 | CACGATGTTCCTCTTGAGGT | 104 | 732 |
| 1047297 | 1321 | 1340 | N/A | N/A | TTGGACTCCTTAATGACCTC | 110 | 733 |
| 1047313 | 1393 | 1412 | 11682 | 11701 | TCGGGCCCCTCATGAGACGG | 99 | 734 |
| 1047329 | 1605 | 1624 | 11894 | 11913 | ATGCCCTCCAGACTGCCCC | 109 | 735 |
| 1047345 | 1640 | 1659 | 11929 | 11948 | CTCCTTCCTCCTCATTCTAA | 89 | 736 |
| 1047361 | 1716 | 1735 | 12005 | 12024 | CAACAGTTTCCATAACAACA | 62 | 737 |
| 1047377 | 1770 | 1789 | 12059 | 12078 | GAGGAAACTCAAAGGCACAG | 82 | 738 |
| 1047393 | 1816 | 1835 | 12105 | 12124 | GGGCCTTCCCTTTCCTGTCT | 64 | 739 |
| 1047409 | 2024 | 2043 | 12313 | 12332 | TCTTAGACTGATCAGGGTCA | 124 | 740 |
| 1047425 | 2166 | 2185 | 12455 | 12474 | GCTCCCACCTGCCCACAGCG | 79 | 741 |
| 1047441 | 2224 | 2243 | 12513 | 12532 | TCCCAGCACCTCATCCCTCT | 109 | 742 |
| 1047457 | 2247 | 2266 | 12536 | 12555 | GCCAGGCAGCCCCCCTCTAT | 100 | 743 |
| 1047473 | 2369 | 2388 | 12658 | 12677 | CAACCCCTACTTGTATGCCT | 73 | 744 |
| 1047489 | 2429 | 2448 | 12718 | 12737 | AGAGGATGAGTCACTTCCTT | 116 | 745 |
| 1047505 | 2469 | 2488 | 12758 | 12777 | CATGGATACATCCCCTTTCT | 83 | 746 |
| 1047521 | 2748 | 2767 | 13037 | 13056 | CAGTGTCTTCACTTTGCTCG | 69 | 747 |
| 1047537 | 2846 | 2865 | 13135 | 13154 | AGTCTGCTCACCAGTCTGCT | 103 | 748 |
| 1047553 | 2884 | 2903 | 13173 | 13192 | GGGCCCTCCCAGTCCCATCT | 105 | 749 |
| 1047569 | 2957 | 2976 | 13246 | 13265 | GAAAGGACACCAAGTCTTGG | 117 | 750 |
| 1047585 | 3050 | 3069 | 13339 | 13358 | TTTGTCTTTATTTTCCTCA | 20 | 751 |
| 1047601 | N/A | N/A | 8751 | 8770 | GATTTTCCCCGTCTTTGGTG | 38 | 752 |
| 1047617 | N/A | N/A | 8901 | 8920 | GTGAGGCTCACTCCCTGTCA | 95 | 753 |
| 1047633 | N/A | N/A | 9060 | 9079 | ACCACCTTTACCACTAACAA | 108 | 754 |
| 1047649 | N/A | N/A | 9107 | 9126 | GCTTGCTCAGAGGCCCCAGA | 59 | 755 |
| 1047665 | N/A | N/A | 9315 | 9334 | TAATATTTAACATTAAGAGC | 135 | 756 |
| 1047681 | N/A | N/A | 8406 | 8425 | GACTCCAGTGCCCTTCCCAC | 109 | 757 |
| 1047697 | N/A | N/A | 8473 | 8492 | TGGATCCCTTTGCCCTGATC | 90 | 758 |
| 1047713 | N/A | N/A | 8557 | 8576 | GCTGCAAGCCCCACCTAGAA | 69 | 759 |
| 1047729 | N/A | N/A | 8692 | 8711 | AACAGAAAACACTCAGAAGG | 97 | 760 |
| 1047745 | N/A | N/A | 3985 | 4004 | AAGGCCCCCTTCCCCATCC | 109 | 761 |
| 1047761 | N/A | N/A | 4158 | 4177 | TGCGGGCATCAGATCCCCGG | 138 | 762 |

TABLE 11-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047777 | N/A | N/A | 4313 | 4332 | TCCTCCTTTATATGGACACA | 111 | 763 |
| 1047793 | N/A | N/A | 4341 | 4360 | ATGGACATCAACCTTCTCCG | 74 | 764 |
| 1047809 | N/A | N/A | 4378 | 4397 | TCCCTCACTTTCTTCACCCC | 100 | 765 |
| 1047825 | N/A | N/A | 4514 | 4533 | CCCAGGTAACCACCTTTTGA | 92 | 766 |
| 1047841 | N/A | N/A | 4689 | 4708 | AAGGTGCCTTATCAGGGTTG | 74 | 767 |
| 1047857 | N/A | N/A | 4716 | 4735 | TGTGGGCTTTTGCCTTAACT | 103 | 768 |
| 1047873 | N/A | N/A | 4841 | 4860 | TACCTGCCTCAGTCTCCCTT | 130 | 769 |
| 1047889 | N/A | N/A | 4998 | 5017 | AATCCTTTCCTCCCTCCCCT | 129 | 770 |
| 1047905 | N/A | N/A | 5103 | 5122 | TCCCCATTCCTCAGCCTTGC | 112 | 771 |
| 1047921 | N/A | N/A | 5317 | 5336 | TGTCTCTCCCTCTCTCAGTT | 88 | 772 |
| 1047937 | N/A | N/A | 5438 | 5457 | CTTGTCTCTTTCCGTCTCCC | 105 | 773 |
| 1047953 | N/A | N/A | 5739 | 5758 | GCAGGCTGGCCCACAGGCAG | 83 | 774 |
| 1047969 | N/A | N/A | 5816 | 5835 | AGAGGATATTCTCCCAGCTT | 80 | 775 |
| 1047985 | N/A | N/A | 5994 | 6013 | GCACCTACTTCATAGTAAGG | 65 | 776 |
| 1048001 | N/A | N/A | 6089 | 6108 | AGTTGGAAATCCAACTCTAC | 88 | 777 |
| 1048017 | N/A | N/A | 6157 | 6176 | AGAGGCTCAGTAACCCAAAA | 90 | 778 |
| 1048033 | N/A | N/A | 6306 | 6325 | CCCCTCTACAGTGTCTTTCC | 101 | 779 |
| 1048049 | N/A | N/A | 6364 | 6383 | TGGCCCTCCCTTCTTCTCTT | 89 | 780 |
| 1048065 | N/A | N/A | 6497 | 6516 | GGCCCTCACCCTGCTCAGAC | 143 | 781 |
| 1048081 | N/A | N/A | 6571 | 6590 | CCTCGCCTGGCCTCACCCTG | 116 | 782 |
| 1048097 | N/A | N/A | 7056 | 7075 | ACTGTGACCCATGGATGCGG | 98 | 783 |
| 1048113 | N/A | N/A | 7343 | 7362 | CGCCCGTCCCCGTCCTGCCC | 92 | 784 |
| 1048129 | N/A | N/A | 7835 | 7854 | TGAAAAGACTCAGTCCCTG | 103 | 785 |
| 1048145 | N/A | N/A | 7947 | 7966 | ATTGGTTGAATCCATCCATC | 106 | 786 |
| 1048161 | N/A | N/A | 8199 | 8218 | TCCTAGCTTTTCCCCAGCA | 92 | 787 |
| 1048177 | N/A | N/A | 9318 | 9337 | CACTAATATTTAACATTAAG | 120 | 788 |
| 1048193 | N/A | N/A | 9475 | 9494 | GACATGCATATCTAGTGGTC | 64 | 789 |
| 1048209 | N/A | N/A | 9595 | 9614 | CTTTCCTACTTCTCTCTGCC | 107 | 790 |
| 1048225 | N/A | N/A | 9634 | 9653 | TGCTCAATACACATAGGTCC | 95 | 791 |
| 1048241 | N/A | N/A | 9806 | 9825 | GAAGTCCCAACTTAGCCACC | 101 | 792 |
| 1048257 | N/A | N/A | 10579 | 10598 | CCTGGCTTTCTGAAAACCCA | 70 | 793 |
| 1048273 | N/A | N/A | 10683 | 10702 | GGCTGGAGAGCCCCCAAATC | 144 | 794 |
| 1048289 | N/A | N/A | 10766 | 10785 | GGCTTCCCCATCGCACCCCC | 117 | 795 |
| 1048305 | N/A | N/A | 10930 | 10949 | ATCCCTCCTTACCTCTCCAT | 106 | 796 |
| 1048321 | N/A | N/A | 10998 | 11017 | CCCCAGGCTTTCCTCCATGG | 81 | 797 |
| 1048337 | N/A | N/A | 11113 | 11132 | CCTTAGAACAGCCTATGGAG | 162 | 798 |

TABLE 11-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048353 | N/A | N/A | 11305 | 11324 | TGGTAGTTTCCTTTTACCAA | 89 | 799 |
| 1048369 | N/A | N/A | 11339 | 11358 | GGCGGATACGCCAAATCCCC | 93 | 800 |
| 1048385 | N/A | N/A | 11547 | 11566 | ACAGACCCCAGGTCCACCAC | 104 | 801 |

TABLE 12

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047154 | 120 | 139 | 3568 | 3587 | GGCCCCCCACCATCATCTCC | 97 | 802 |
| 1047170 | 226 | 245 | 3674 | 3693 | GCATTGAGTGCCCCAGCCAG | 128 | 803 |
| 1047186 | 471 | 490 | 3919 | 3938 | CCCTCTCAACCTCCAGCCGG | 3* | 804 |
| 1047202 | 541 | 560 | 4926 | 4945 | GCTTCCAGCCTCAGGTTGGT | 18* | 805 |
| 1047218 | 628 | 647 | 5217 | 5236 | TCCAGCGACTCAATCTTCCT | 100 | 806 |
| 1047234 | 723 | 742 | 5609 | 5628 | CGTCAAGCTCCACATGGACC | 144 | 807 |
| 1047250 | 1017 | 1036 | 7589 | 7608 | AACTGGCCGCCTCCCGCACG | 127 | 808 |
| 1047266 | 1206 | 1225 | 8355 | 8374 | GGTTGGAGAAGGTCTGCACG | 77 | 809 |
| 1047282 | 1275 | 1294 | 10889 | 10908 | CCACGATGTTCCTCTTGAGG | 157 | 810 |
| 1047298 | 1322 | 1341 | 11611 | 11630 | CTTGGACTCCTTAATGACCT | 64 | 811 |
| 1047314 | 1395 | 1414 | 11684 | 11703 | GCTCGGGCCCCTCATGAGAC | 100 | 812 |
| 1047330 | 1606 | 1625 | 11895 | 11914 | CATGCCCCTCCAGACTGCCC | 106 | 813 |
| 1047346 | 1657 | 1676 | 11946 | 11965 | CGCCCTCCTCCCCTTCTCTC | 79 | 814 |
| 1047362 | 1718 | 1737 | 12007 | 12026 | GGCAACAGTTTCCATAACAA | 31 | 815 |
| 1047378 | 1771 | 1790 | 12060 | 12079 | TGAGGAAACTCAAAGGCACA | 79 | 816 |
| 1047394 | 1835 | 1854 | 12124 | 12143 | CAGGGCTACCTTGTCTGTGG | 40 | 817 |
| 1047410 | 2025 | 2044 | 12314 | 12333 | ATCTTAGACTGATCAGGGTC | 67 | 818 |
| 1047426 | 2167 | 2186 | 12456 | 12475 | AGCTCCCACCTGCCCACAGC | 94 | 819 |
| 1047442 | 2226 | 2245 | 12515 | 12534 | CCTCCCAGCACCTCATCCCT | 97 | 820 |
| 1047458 | 2268 | 2287 | 12557 | 12576 | TCTCTGTACCCACAGCTGGG | 84 | 821 |
| 1047474 | 2371 | 2390 | 12660 | 12679 | CACAACCCCTACTTGTATGC | 61 | 822 |
| 1047490 | 2442 | 2461 | 12731 | 12750 | TTCAGCATCTTCAAGAGGAT | 92 | 823 |
| 1047506 | 2470 | 2489 | 12759 | 12778 | CCATGGATACATCCCCTTTC | 151 | 824 |
| 1047522 | 2749 | 2768 | 13038 | 13057 | CCAGTGTCTTCACTTTGCTC | 44 | 825 |
| 1047538 | 2847 | 2866 | 13136 | 13155 | CAGTCTGCTCACCAGTCTGC | 103 | 826 |
| 1047554 | 2885 | 2904 | 13174 | 13193 | TGGGCCCTCCCAGTCCCATC | 172 | 827 |
| 1047570 | 2958 | 2977 | 13247 | 13266 | GGAAAGGACACCAAGTCTTG | 90 | 828 |

TABLE 12-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047586 | 3051 | 3070 | 13340 | 13359 | ATTTGTCTTTATTTTTCCTC | 32 | 829 |
| 1047602 | N/A | N/A | 8754 | 8773 | TGTGATTTTCCCCGTCTTTG | 54 | 830 |
| 1047618 | N/A | N/A | 8902 | 8921 | GGTGAGGCTCACTCCCTGTC | 65 | 831 |
| 1047634 | N/A | N/A | 9061 | 9080 | CACCACCTTTACCACTAACA | 88 | 832 |
| 1047650 | N/A | N/A | 9109 | 9128 | CTGCTTGCTCAGAGGCCCCA | 115 | 833 |
| 1047666 | N/A | N/A | 8372 | 8391 | CTGACCTCGAATCTGCAGGT | 84 | 834 |
| 1047682 | N/A | N/A | 8412 | 8431 | GGGCAGGACTCCAGTGCCCT | 118 | 835 |
| 1047698 | N/A | N/A | 8474 | 8493 | CTGGATCCCTTTGCCCTGAT | 100 | 836 |
| 1047714 | N/A | N/A | 8626 | 8645 | CACCCAGTTCTGCTGTCGAA | 94 | 837 |
| 1047730 | N/A | N/A | 8696 | 8715 | CAAAAACAGAAAACACTCAG | 160 | 838 |
| 1047746 | N/A | N/A | 3987 | 4006 | ACAAGGCCCCCCTTCCCCAT | 57 | 839 |
| 1047762 | N/A | N/A | 4215 | 4234 | CACTGCTTTCCCCAGTAGGG | 48 | 840 |
| 1047778 | N/A | N/A | 4314 | 4333 | CTCCTCCTTTATATGGACAC | 96 | 841 |
| 1047794 | N/A | N/A | 4345 | 4364 | CCTCATGGACATCAACCTTC | 92 | 842 |
| 1047810 | N/A | N/A | 4379 | 4398 | TTCCCTCACTTTCTTCACCC | 102 | 843 |
| 1047826 | N/A | N/A | 4515 | 4534 | TCCCAGGTAACCACCTTTTG | 76 | 844 |
| 1047842 | N/A | N/A | 4691 | 4710 | CTAAGGTGCCTTATCAGGGT | 78 | 845 |
| 1047858 | N/A | N/A | 4794 | 4813 | ACCCAGGACCAGTAGAGCAG | 84 | 846 |
| 1047874 | N/A | N/A | 4843 | 4862 | AATACCTGCCTCAGTCTCCC | 106 | 847 |
| 1047890 | N/A | N/A | 4999 | 5018 | CAATCCTTTCCTCCCTCCCC | 109 | 848 |
| 1047906 | N/A | N/A | 5104 | 5123 | CTCCCCATTCCTCAGCCTTG | 90 | 849 |
| 1047922 | N/A | N/A | 5334 | 5353 | CTCAGCTTCTCTGTCTCTGT | 123 | 850 |
| 1047938 | N/A | N/A | 5465 | 5484 | CCCCTCGGCCAGGAGTTCGA | 123 | 851 |
| 1047954 | N/A | N/A | 5781 | 5800 | CCCCATTCTCTTGTACAGAG | 98 | 852 |
| 1047970 | N/A | N/A | 5817 | 5836 | GAGAGGATATTCTCCCAGCT | 151 | 853 |
| 1047986 | N/A | N/A | 6001 | 6020 | AAGAACAGCACCTACTTCAT | 85 | 854 |
| 1048002 | N/A | N/A | 6090 | 6109 | GAGTTGGAAATCCAACTCTA | 97 | 855 |
| 1048018 | N/A | N/A | 6159 | 6178 | GTAGAGGCTCAGTAACCCAA | 51 | 856 |
| 1048034 | N/A | N/A | 6310 | 6329 | ATGCCCCTCTACAGTGTCT | 71 | 857 |
| 1048050 | N/A | N/A | 6366 | 6385 | AATGCCCTCCCTTCTTCTC | 177 | 858 |
| 1048066 | N/A | N/A | 6503 | 6522 | CCATCGGGCCCTCACCCTGC | 110 | 859 |
| 1048082 | N/A | N/A | 6951 | 6970 | ACCTTCCACACTGACAGCTG | 169 | 860 |
| 1048098 | N/A | N/A | 7058 | 7077 | CAACTGTGACCCATGGATGC | 78 | 861 |
| 1048114 | N/A | N/A | 7349 | 7368 | CTGCTCCGCCCGTCCCCGTC | 120 | 862 |
| 1048130 | N/A | N/A | 7836 | 7855 | CTGAAAAGACTCAGTCCCT | 118 | 863 |
| 1048146 | N/A | N/A | 7949 | 7968 | ATATTGGTTGAATCCATCCA | 102 | 864 |

TABLE 12-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048162 | N/A | N/A | 8211 | 8230 | TCTAACTCCATCTCCTAGCT | 98 | 865 |
| 1048178 | N/A | N/A | 9319 | 9338 | TCACTAATATTTAACATTAA | 84 | 866 |
| 1048194 | N/A | N/A | 9492 | 9511 | GCTGAATTAAGTCCTGAGAC | 55 | 867 |
| 1048210 | N/A | N/A | 9596 | 9615 | TCTTTCCTACTTCTCTCTGC | 82 | 868 |
| 1048226 | N/A | N/A | 9662 | 9681 | AGGCTGTTAAACATGTGGCA | 71 | 869 |
| 1048242 | N/A | N/A | 9807 | 9826 | AGAAGTCCCAACTTAGCCAC | 85 | 870 |
| 1048258 | N/A | N/A | 10580 | 10599 | ACCTGGCTTTCTGAAAACCC | 79 | 871 |
| 1048274 | N/A | N/A | 10698 | 10717 | AGGCTCTTCCAAACGGGCTG | 103 | 872 |
| 1048290 | N/A | N/A | 10768 | 10787 | CCGGCTTCCCCATCGCACCC | 81 | 873 |
| 1048306 | N/A | N/A | 10931 | 10950 | AATCCCTCCTTACCTCTCCA | 116 | 874 |
| 1048322 | N/A | N/A | 11004 | 11023 | TGCCAGCCCCAGGCTTTCCT | 66 | 875 |
| 1048338 | N/A | N/A | 11117 | 11136 | CTCCCCTTAGAACAGCCTAT | 88 | 876 |
| 1048354 | N/A | N/A | 11306 | 11325 | CTGGTAGTTTCCTTTTACCA | 113 | 877 |
| 1048370 | N/A | N/A | 11340 | 11359 | TGGCGGATACGCCAAATCCC | 75 | 878 |
| 1048386 | N/A | N/A | 11555 | 11574 | GAGTTCACACAGACCCCAGG | 85 | 879 |

TABLE 13

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047155 | 121 | 140 | 3569 | 3588 | AGGCCCCCACCATCATCTC | 124 | 880 |
| 1047171 | 228 | 247 | 3676 | 3695 | CAGCATTGAGTGCCCCAGCC | 104 | 881 |
| 1047187 | 472 | 491 | 3920 | 3939 | TCCCTCTCAACCTCCAGCCG | 7* | 882 |
| 1047203 | 542 | 561 | 4927 | 4946 | GGCTTCCAGCCTCAGGTTGG | 18* | 883 |
| 1047219 | 629 | 648 | 5218 | 5237 | CTCCAGCGACTCAATCTTCC | 86 | 884 |
| 1047235 | 761 | 780 | 5647 | 5666 | GATCTCTTTCAGGGCTGCGG | 51 | 885 |
| 1047251 | 1019 | 1038 | 7591 | 7610 | ATAACTGGCCGCCTCCCGCA | 143 | 886 |
| 1047267 | 1223 | 1242 | N/A | N/A | GGTTTCTCGAATCTGCAGGT | 65 | 887 |
| 1047283 | 1280 | 1299 | 10894 | 10913 | CTTCACCACGATGTTCCTCT | 73 | 888 |
| 1047299 | 1323 | 1342 | 11612 | 11631 | GCTTGGACTCCTTAATGACC | 91 | 889 |
| 1047315 | 1396 | 1415 | 11685 | 11704 | TGCTCGGGCCCCTCATGAGA | 84 | 890 |
| 1047331 | 1607 | 1626 | 11896 | 11915 | CCATGCCCCTCCAGACTGCC | 66 | 891 |
| 1047347 | 1658 | 1677 | 11947 | 11966 | CCGCCCTCCTCCCCTTCTCT | 73 | 892 |
| 1047363 | 1721 | 1740 | 12010 | 12029 | TCTGGCAACAGTTTCCATAA | 66 | 893 |

TABLE 13-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047379 | 1772 | 1791 | 12061 | 12080 | CTGAGGAAACTCAAAGGCAC | 100 | 894 |
| 1047395 | 1837 | 1856 | 12126 | 12145 | GCCAGGGCTACCTTGTCTGT | 80 | 895 |
| 1047411 | 2026 | 2045 | 12315 | 12334 | CATCTTAGACTGATCAGGGT | 72 | 896 |
| 1047427 | 2169 | 2188 | 12458 | 12477 | CAAGCTCCCACCTGCCCACA | 111 | 897 |
| 1047443 | 2232 | 2251 | 12521 | 12540 | TCTATCCCTCCCAGCACCTC | 80 | 898 |
| 1047459 | 2269 | 2288 | 12558 | 12577 | CTCTCTGTACCCACAGCTGG | 85 | 899 |
| 1047475 | 2372 | 2391 | 12661 | 12680 | CCACAACCCCTACTTGTATG | 69 | 900 |
| 1047491 | 2443 | 2462 | 12732 | 12751 | TTTCAGCATCTTCAAGAGGA | 121 | 901 |
| 1047507 | 2471 | 2490 | 12760 | 12779 | CCCATGGATACATCCCCTTT | 79 | 902 |
| 1047523 | 2751 | 2770 | 13040 | 13059 | AGCCAGTGTCTTCACTTTGC | 60 | 903 |
| 1047539 | 2855 | 2874 | 13144 | 13163 | GATCCCACCAGTCTGCTCAC | 84 | 904 |
| 1047555 | 2886 | 2905 | 13175 | 13194 | GTGGGCCCTCCCAGTCCCAT | 81 | 905 |
| 1047571 | 3010 | 3029 | 13299 | 13318 | TGCCCTGAAGATTAGCAGCA | 103 | 906 |
| 1047587 | 3052 | 3071 | 13341 | 13360 | CATTTGTCTTTATTTTTCCT | 14 | 907 |
| 1047603 | N/A | N/A | 8755 | 8774 | TTGTGATTTTCCCCGTCTTT | 75 | 908 |
| 1047619 | N/A | N/A | 8969 | 8988 | ACGCAGTCCAGGCCCTTTAG | 57 | 909 |
| 1047635 | N/A | N/A | 9063 | 9082 | CTCACCACCTTTACCACTAA | 113 | 910 |
| 1047651 | N/A | N/A | 9128 | 9147 | AGAGGTGAGACAGAGGCTGC | 112 | 911 |
| 1047667 | N/A | N/A | 8374 | 8393 | TACTGACCTCGAATCTGCAG | 85 | 912 |
| 1047683 | N/A | N/A | 8432 | 8451 | CCTACAGGCCCTGGAGGAGG | 85 | 913 |
| 1047699 | N/A | N/A | 8476 | 8495 | AGCTGGATCCCTTTGCCCTG | 97 | 914 |
| 1047715 | N/A | N/A | 8630 | 8649 | CTCTCACCCAGTTCTGCTGT | 77 | 915 |
| 1047731 | N/A | N/A | 8723 | 8742 | CCCTGTAGTGACAAGCAGTT | 84 | 916 |
| 1047747 | N/A | N/A | 3997 | 4016 | CCTTCTGCTCACAAGGCCCC | 93 | 917 |
| 1047763 | N/A | N/A | 4257 | 4276 | AAGCCCAGCCATGAATGAAA | 83 | 918 |
| 1047779 | N/A | N/A | 4316 | 4335 | AACTCCTCCTTTATATGGAC | 91 | 919 |
| 1047795 | N/A | N/A | 4353 | 4372 | CCAATCTCCCTCATGGACAT | 66 | 920 |
| 1047811 | N/A | N/A | 4386 | 4405 | CTGCTCTTTCCCTCACTTTC | 103 | 921 |
| 1047827 | N/A | N/A | 4516 | 4535 | ATCCCAGGTAACCACCTTTT | 85 | 922 |
| 1047843 | N/A | N/A | 4692 | 4711 | ACTAAGGTGCCTTATCAGGG | 117 | 923 |
| 1047859 | N/A | N/A | 4795 | 4814 | CACCCAGGACCAGTAGAGCA | 56 | 924 |
| 1047875 | N/A | N/A | 4848 | 4867 | ACTTGAATACCTGCCTCAGT | 85 | 925 |
| 1047891 | N/A | N/A | 5001 | 5020 | ATCAATCCTTTCCTCCCTCC | 102 | 926 |
| 1047907 | N/A | N/A | 5107 | 5126 | CTTCTCCCCATTCCTCAGCC | 56 | 927 |
| 1047923 | N/A | N/A | 5349 | 5368 | AGTGTCTCTCAGTCTCAG | 83 | 928 |
| 1047939 | N/A | N/A | 5477 | 5496 | CTCTTCTGCCTGCCCCTCGG | 101 | 929 |

TABLE 13-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047955 | N/A | N/A | 5783 | 5802 | TCCCCCATTCTCTTGTACAG | 49 | 930 |
| 1047971 | N/A | N/A | 5818 | 5837 | GGAGAGGATATTCTCCCAGC | 93 | 931 |
| 1047987 | N/A | N/A | 6007 | 6026 | CTGTCAAAGAACAGCACCTA | 112 | 932 |
| 1048003 | N/A | N/A | 6091 | 6110 | AGAGTTGGAAATCCAACTCT | 92 | 933 |
| 1048019 | N/A | N/A | 6201 | 6220 | GGTCAGACACCTCTCTGTGT | 82 | 934 |
| 1048035 | N/A | N/A | 6321 | 6340 | GCCTAGCCCAAATGCCCCCT | 71 | 935 |
| 1048051 | N/A | N/A | 6384 | 6403 | GCTCTGTCCTCCACTAGGAA | 97 | 936 |
| 1048067 | N/A | N/A | 6504 | 6523 | CCCATCGGGCCCTCACCCTG | 88 | 937 |
| 1048083 | N/A | N/A | 6954 | 6973 | AGAACCTTCCACACTGACAG | 76 | 938 |
| 1048099 | N/A | N/A | 7060 | 7079 | AACAACTGTGACCCATGGAT | 74 | 939 |
| 1048115 | N/A | N/A | 7351 | 7370 | CCCTGCTCCGCCCGTCCCCG | 98 | 940 |
| 1048131 | N/A | N/A | 7837 | 7856 | GCTGAAAAAGACTCAGTCCC | 84 | 941 |
| 1048147 | N/A | N/A | 7973 | 7992 | GTCCTTGGCCTTGAGGCCTA | 95 | 942 |
| 1048163 | N/A | N/A | 8213 | 8232 | AGTCTAACTCCATCTCCTAG | 88 | 943 |
| 1048179 | N/A | N/A | 9322 | 9341 | CATTCACTAATATTTAACAT | 110 | 944 |
| 1048195 | N/A | N/A | 9507 | 9526 | GTTAGCCTTTCTGATGCTGA | 53 | 945 |
| 1048211 | N/A | N/A | 9597 | 9616 | CTCTTTCCTACTTCTCTCTG | 91 | 946 |
| 1048227 | N/A | N/A | 9708 | 9727 | GGCCTACTTCTCTAGGTGGG | 82 | 947 |
| 1048243 | N/A | N/A | 9808 | 9827 | AAGAAGTCCCAACTTAGCCA | 141 | 948 |
| 1048259 | N/A | N/A | 10602 | 10621 | CCTCTGCAAGCCCTGGCCTG | 95 | 949 |
| 1048275 | N/A | N/A | 10699 | 10718 | TAGGCTCTTCCAAACGGGCT | 89 | 950 |
| 1048291 | N/A | N/A | 10769 | 10788 | CCCGGCTTCCCCATCGCACC | 79 | 951 |
| 1048307 | N/A | N/A | 10934 | 10953 | CCAAATCCCTCCTTACCTCT | 156 | 952 |
| 1048323 | N/A | N/A | 11017 | 11036 | GGAACCTTCTATGTGCCAGC | 74 | 953 |
| 1048339 | N/A | N/A | 11132 | 11151 | GCTTTGGTACCAAGGCTCCC | 192 | 954 |
| 1048355 | N/A | N/A | 11307 | 11326 | CCTGGTAGTTTCCTTTTACC | 52 | 955 |
| 1048371 | N/A | N/A | 11379 | 11398 | GCTGGAGTAAGATGAGCTCC | 86 | 956 |
| 1048387 | N/A | N/A | 11570 | 11589 | CAGTGCAACAGTTAGGAGTT | 66 | 957 |

TABLE 14

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047156 | 122 | 141 | 3570 | 3589 | CAGGCCCCCACCATCATCT | 90 | 958 |
| 1047172 | 237 | 256 | 3685 | 3704 | CCTTGAAGCCAGCATTGAGT | 89 | 959 |

TABLE 14-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047188 | 473 | 492 | 3921 | 3940 | GTCCCTCTCAACCTCCAGCC | 6* | 960 |
| 1047204 | 545 | 564 | 4930 | 4949 | CTCGGCTTCCAGCCTCAGGT | 37* | 961 |
| 1047220 | 634 | 653 | 5223 | 5242 | TCCTCCTCCAGCGACTCAAT | 94 | 962 |
| 1047236 | 766 | 785 | 5652 | 5671 | GTGCGGATCTCTTTCAGGGC | 63 | 963 |
| 1047252 | 1020 | 1039 | 7592 | 7611 | GATAACTGGCCGCCTCCCGC | 113 | 964 |
| 1047268 | 1225 | 1244 | N/A | N/A | CTGGTTTCTCGAATCTGCAG | 83 | 965 |
| 1047284 | 1283 | 1302 | 10897 | 10916 | GGTCTTCACCACGATGTTCC | 94 | 966 |
| 1047300 | 1345 | 1364 | 11634 | 11653 | CACATCACATCCTTGTGCTC | 75 | 967 |
| 1047316 | 1398 | 1417 | 11687 | 11706 | TCTGCTCGGGCCCCTCATGA | 96 | 968 |
| 1047332 | 1608 | 1627 | 11897 | 11916 | GCCATGCCCCTCCAGACTGC | 73 | 969 |
| 1047348 | 1659 | 1678 | 11948 | 11967 | CCCGCCCTCCTCCCCTTCTC | 107 | 970 |
| 1047364 | 1723 | 1742 | 12012 | 12031 | TCTCTGGCAACAGTTTCCAT | 65 | 971 |
| 1047380 | 1773 | 1792 | 12062 | 12081 | CCTGAGGAAACTCAAAGGCA | 92 | 972 |
| 1047396 | 1838 | 1857 | 12127 | 12146 | GGCCAGGGCTACCTTGTCTG | 67 | 973 |
| 1047412 | 2027 | 2046 | 12316 | 12335 | CCATCTTAGACTGATCAGGG | 76 | 974 |
| 1047428 | 2170 | 2189 | 12459 | 12478 | TCAAGCTCCCACCTGCCCAC | 127 | 975 |
| 1047444 | 2233 | 2252 | 12522 | 12541 | CTCTATCCCTCCCAGCACCT | 42 | 976 |
| 1047460 | 2270 | 2289 | 12559 | 12578 | CCTCTCTGTACCCACAGCTG | 94 | 977 |
| 1047476 | 2373 | 2392 | 12662 | 12681 | CCCACAACCCCTACTTGTAT | 115 | 978 |
| 1047492 | 2449 | 2468 | 12738 | 12757 | CTCCTGTTTCAGCATCTTCA | 45 | 979 |
| 1047508 | 2472 | 2491 | 12761 | 12780 | CCCCATGGATACATCCCCTT | 86 | 980 |
| 1047524 | 2759 | 2778 | 13048 | 13067 | GGAATATGAGCCAGTGTCTT | 63 | 981 |
| 1047540 | 2857 | 2876 | 13146 | 13165 | CAGATCCCACCAGTCTGCTC | 89 | 982 |
| 1047556 | 2889 | 2908 | 13178 | 13197 | GAAGTGGGCCCTCCCAGTCC | 113 | 983 |
| 1047572 | 3011 | 3030 | 13300 | 13319 | GTGCCCTGAAGATTAGCAGC | 85 | 984 |
| 1047588 | 3053 | 3072 | 13342 | 13361 | GCATTTGTCTTTATTTTTCC | 11 | 985 |
| 1047604 | N/A | N/A | 8756 | 8775 | CTTGTGATTTTCCCCGTCTT | 74 | 986 |
| 1047620 | N/A | N/A | 8972 | 8991 | ATGACGCAGTCCAGGCCCTT | 78 | 987 |
| 1047636 | N/A | N/A | 9064 | 9083 | ACTCACCACCTTTACCACTA | 85 | 988 |
| 1047652 | N/A | N/A | 9129 | 9148 | AAGAGGTGAGACAGAGGCTG | 66 | 989 |
| 1047668 | N/A | N/A | 8375 | 8394 | GTACTGACCTCGAATCTGCA | 96 | 990 |
| 1047684 | N/A | N/A | 8437 | 8456 | AGCAACCTACAGGCCCTGGA | 116 | 991 |
| 1047700 | N/A | N/A | 8477 | 8496 | GAGCTGGATCCCTTTGCCCT | 82 | 992 |
| 1047716 | N/A | N/A | 8631 | 8650 | GCTCTCACCCAGTTCTGCTG | 83 | 993 |
| 1047732 | N/A | N/A | 8725 | 8744 | CCCCCTGTAGTGACAAGCAG | 71 | 994 |
| 1047748 | N/A | N/A | 4051 | 4070 | GAGGTTCGGCCCCTCCCTGA | 68 | 995 |

TABLE 14-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047764 | N/A | N/A | 4258 | 4277 | AAAGCCCAGCCATGAATGAA | 111 | 996 |
| 1047780 | N/A | N/A | 4317 | 4336 | CAACTCCTCCTTTATATGGA | 104 | 997 |
| 1047796 | N/A | N/A | 4355 | 4374 | ATCCAATCTCCCTCATGGAC | 78 | 998 |
| 1047812 | N/A | N/A | 4388 | 4407 | GCCTGCTCTTTCCCTCACTT | 98 | 999 |
| 1047828 | N/A | N/A | 4520 | 4539 | TCTGATCCCAGGTAACCACC | 81 | 1000 |
| 1047844 | N/A | N/A | 4693 | 4712 | TACTAAGGTGCCTTATCAGG | 92 | 1001 |
| 1047860 | N/A | N/A | 4800 | 4819 | ACCCCCACCCAGGACCAGTA | 94 | 1002 |
| 1047876 | N/A | N/A | 4851 | 4870 | GACACTTGAATACCTGCCTC | 89 | 1003 |
| 1047892 | N/A | N/A | 5002 | 5021 | CATCAATCCTTTCCTCCCTC | 79 | 1004 |
| 1047908 | N/A | N/A | 5109 | 5128 | TCCTTCTCCCCATTCCTCAG | 88 | 1005 |
| 1047924 | N/A | N/A | 5355 | 5374 | TCTCTGAGTGTCTCTCTCAG | 92 | 1006 |
| 1047940 | N/A | N/A | 5478 | 5497 | CCTCTTCTGCCTGCCCCTCG | 111 | 1007 |
| 1047956 | N/A | N/A | 5784 | 5803 | TTCCCCATTCTCTTGTACA | 98 | 1008 |
| 1047972 | N/A | N/A | 5836 | 5855 | GGTGAAAGTCAGTCACCTGG | 90 | 1009 |
| 1047988 | N/A | N/A | 6009 | 6028 | ATCTGTCAAAGAACAGCACC | 96 | 1010 |
| 1048004 | N/A | N/A | 6092 | 6111 | TAGAGTTGGAAATCCAACTC | 92 | 1011 |
| 1048020 | N/A | N/A | 6211 | 6230 | ACACCTTCCAGGTCAGACAC | 71 | 1012 |
| 1048036 | N/A | N/A | 6322 | 6341 | TGCCTAGCCCAAATGCCCCC | 111 | 1013 |
| 1048052 | N/A | N/A | 6386 | 6405 | AGGCTCTGTCCTCCACTAGG | 87 | 1014 |
| 1048068 | N/A | N/A | 6513 | 6532 | CCTCCCAGCCCCATCGGGCC | 146 | 1015 |
| 1048084 | N/A | N/A | 6955 | 6974 | CAGAACCTTCCACACTGACA | 123 | 1016 |
| 1048100 | N/A | N/A | 7065 | 7084 | TTCCCAACAACTGTGACCCA | 69 | 1017 |
| 1048116 | N/A | N/A | 7387 | 7406 | TGGCCCTTCTCCCCTGGCAT | 122 | 1018 |
| 1048132 | N/A | N/A | 7840 | 7859 | AAGGCTGAAAAAGACTCAGT | 82 | 1019 |
| 1048148 | N/A | N/A | 7982 | 8001 | GTGACCCAAGTCCTTGGCCT | 85 | 1020 |
| 1048164 | N/A | N/A | 8217 | 8236 | GGAAAGTCTAACTCCATCTC | 93 | 1021 |
| 1048180 | N/A | N/A | 9323 | 9342 | ACATTCACTAATATTTAACA | 91 | 1022 |
| 1048196 | N/A | N/A | 9510 | 9529 | CTGGTTAGCCTTTCTGATGC | 51 | 1023 |
| 1048212 | N/A | N/A | 9599 | 9618 | TCCTCTTTCCTACTTCTCTC | 73 | 1024 |
| 1048228 | N/A | N/A | 9709 | 9728 | GGGCCTACTTCTCTAGGTGG | 48 | 1025 |
| 1048244 | N/A | N/A | 9813 | 9832 | AGCTCAAGAAGTCCCAACTT | 87 | 1026 |
| 1048260 | N/A | N/A | 10616 | 10635 | GCTTCATTTCAGCCCCTCTG | 82 | 1027 |
| 1048276 | N/A | N/A | 10700 | 10719 | CTAGGCTCTTCCAAACGGGC | 94 | 1028 |
| 1048292 | N/A | N/A | 10771 | 10790 | TGCCCGGCTTCCCCATCGCA | 98 | 1029 |
| 1048308 | N/A | N/A | 10936 | 10955 | GCCCAAATCCCTCCTTACCT | 95 | 1030 |
| 1048324 | N/A | N/A | 11021 | 11040 | GCTGGGAACCTTCTATGTGC | 64 | 1031 |

TABLE 14-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048340 | N/A | N/A | 11133 | 11152 | GGCTTTGGTACCAAGGCTCC | 89 | 1032 |
| 1048356 | N/A | N/A | 11309 | 11328 | CCCCTGGTAGTTTCCTTTTA | 94 | 1033 |
| 1048372 | N/A | N/A | 11433 | 11452 | TGGTGAGATAACACTGGGAA | 51 | 1034 |
| 1048388 | N/A | N/A | 11571 | 11590 | ACAGTGCAACAGTTAGGAGT | 73 | 1035 |

TABLE 15

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047157 | 123 | 142 | 3571 | 3590 | CCAGGCCCCCACCATCATC | 116 | 1036 |
| 1047173 | 239 | 258 | 3687 | 3706 | CTCCTTGAAGCCAGCATTGA | 95 | 1037 |
| 1047189 | 474 | 493 | 3922 | 3941 | TGTCCCTCTCAACCTCCAGC | 11* | 1038 |
| 1047205 | 547 | 566 | 4932 | 4951 | TTCTCGGCTTCCAGCCTCAG | 31* | 1039 |
| 1047221 | 637 | 656 | 5226 | 5245 | ATCTCCTCCTCCAGCGACTC | 83 | 1040 |
| 1047237 | 786 | 805 | 5672 | 5691 | ACGCCATTGCCTCATACTGC | 104 | 1041 |
| 1047253 | 1021 | 1040 | 7593 | 7612 | TGATAACTGGCCGCCTCCCG | 94 | 1042 |
| 1047269 | 1227 | 1246 | N/A | N/A | GGCTGGTTTCTCGAATCTGC | 92 | 1043 |
| 1047285 | 1285 | 1304 | 10899 | 10918 | ACGGTCTTCACCACGATGTT | 86 | 1044 |
| 1047301 | 1346 | 1365 | 11635 | 11654 | TCACATCACATCCTTGTGCT | 79 | 1045 |
| 1047317 | 1406 | 1425 | 11695 | 11714 | ATCCTGCTTCTGCTCGGGCC | 98 | 1046 |
| 1047333 | 1610 | 1629 | 11899 | 11918 | TGGCCATGCCCCTCCAGACT | 74 | 1047 |
| 1047349 | 1660 | 1679 | 11949 | 11968 | CCCCGCCCTCCTCCCCTTCT | 98 | 1048 |
| 1047365 | 1724 | 1743 | 12013 | 12032 | ATCTCTGGCAACAGTTTCCA | 60 | 1049 |
| 1047381 | 1774 | 1793 | 12063 | 12082 | GCCTGAGGAAACTCAAAGGC | 91 | 1050 |
| 1047397 | 1839 | 1858 | 12128 | 12147 | TGGCCAGGGCTACCTTGTCT | 82 | 1051 |
| 1047413 | 2033 | 2052 | 12322 | 12341 | CCCCACCCATCTTAGACTGA | 84 | 1052 |
| 1047429 | 2172 | 2191 | 12461 | 12480 | AATCAAGCTCCCACCTGCCC | 45 | 1053 |
| 1047445 | 2234 | 2253 | 12523 | 12542 | CCTCTATCCCTCCCAGCACC | 104 | 1054 |
| 1047461 | 2275 | 2294 | 12564 | 12583 | CTTGACCTCTCTGTACCCAC | 67 | 1055 |
| 1047477 | 2375 | 2394 | 12664 | 12683 | CACCCACAACCCCTACTTGT | 97 | 1056 |
| 1047493 | 2450 | 2469 | 12739 | 12758 | TCTCCTGTTTCAGCATCTTC | 58 | 1057 |
| 1047509 | 2478 | 2497 | 12767 | 12786 | CCCTGCCCCCATGGATACAT | 76 | 1058 |
| 1047525 | 2765 | 2784 | 13054 | 13073 | GCTGCAGGAATATGAGCCAG | 84 | 1059 |
| 1047541 | 2858 | 2877 | 13147 | 13166 | ACAGATCCCACCAGTCTGCT | 98 | 1060 |

TABLE 15-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047557 | 2890 | 2909 | 13179 | 13198 | TGAAGTGGGCCCTCCCAGTC | 87 | 1061 |
| 1047573 | 3016 | 3035 | 13305 | 13324 | CAGCAGTGCCCTGAAGATTA | 45 | 1062 |
| 1047589 | 3054 | 3073 | 13343 | 13362 | AGCATTTGTCTTTATTTTTC | 17 | 1063 |
| 1047605 | N/A | N/A | 8757 | 8776 | CCTTGTGATTTTCCCCGTCT | 64 | 1064 |
| 1047621 | N/A | N/A | 9023 | 9042 | TACAGTTACTCTGTACCACG | 118 | 1065 |
| 1047637 | N/A | N/A | 9065 | 9084 | GACTCACCACCTTTACCACT | 87 | 1066 |
| 1047653 | N/A | N/A | 9199 | 9218 | GATGAAAGAATAAAGCAGAG | 102 | 1067 |
| 1047669 | N/A | N/A | 8376 | 8395 | TGTACTGACCTCGAATCTGC | 90 | 1068 |
| 1047685 | N/A | N/A | 8439 | 8458 | GGAGCAACCTACAGGCCCTG | 104 | 1069 |
| 1047701 | N/A | N/A | 8478 | 8497 | AGAGCTGGATCCCTTTGCCC | 87 | 1070 |
| 1047717 | N/A | N/A | 8632 | 8651 | AGCTCTCACCCAGTTCTGCT | 62 | 1071 |
| 1047733 | N/A | N/A | 8731 | 8750 | CTTTTGCCCCCTGTAGTGAC | 56 | 1072 |
| 1047749 | N/A | N/A | 4088 | 4107 | GTGCCCCATCAAGAGGTAGG | 147 | 1073 |
| 1047765 | N/A | N/A | 4260 | 4279 | ACAAAGCCCAGCCATGAATG | 142 | 1074 |
| 1047781 | N/A | N/A | 4318 | 4337 | CCAACTCCTCCTTTATATGG | 74 | 1075 |
| 1047797 | N/A | N/A | 4356 | 4375 | AATCCAATCTCCCTCATGGA | 93 | 1076 |
| 1047813 | N/A | N/A | 4390 | 4409 | CTGCCTGCTCTTTCCCTCAC | 99 | 1077 |
| 1047829 | N/A | N/A | 4521 | 4540 | CTCTGATCCCAGGTAACCAC | 96 | 1078 |
| 1047845 | N/A | N/A | 4700 | 4719 | AACTCATTACTAAGGTGCCT | 101 | 1079 |
| 1047861 | N/A | N/A | 4801 | 4820 | CACCCCACCCAGGACCAGT | 90 | 1080 |
| 1047877 | N/A | N/A | 4852 | 4871 | GGACACTTGAATACCTGCCT | 84 | 1081 |
| 1047893 | N/A | N/A | 5003 | 5022 | CCATCAATCCTTTCCTCCCT | 82 | 1082 |
| 1047909 | N/A | N/A | 5112 | 5131 | GGCTCCTTCTCCCCATTCCT | 92 | 1083 |
| 1047925 | N/A | N/A | 5368 | 5387 | TGTTTCTCTCCTCTCTCTGA | 113 | 1084 |
| 1047941 | N/A | N/A | 5484 | 5503 | TTGTGTCCTCTTCTGCCTGC | 93 | 1085 |
| 1047957 | N/A | N/A | 5786 | 5805 | CCTTCCCCCATTCTCTTGTA | 87 | 1086 |
| 1047973 | N/A | N/A | 5842 | 5861 | TTCTCTGGTGAAAGTCAGTC | 95 | 1087 |
| 1047989 | N/A | N/A | 6012 | 6031 | CTCATCTGTCAAAGAACAGC | 102 | 1088 |
| 1048005 | N/A | N/A | 6110 | 6129 | CTCCCAAGTGAGATGTGCTA | 112 | 1089 |
| 1048021 | N/A | N/A | 6212 | 6231 | CACACCTTCCAGGTCAGACA | 70 | 1090 |
| 1048037 | N/A | N/A | 6323 | 6342 | CTGCCTAGCCCAAATGCCCC | 86 | 1091 |
| 1048053 | N/A | N/A | 6396 | 6415 | TTCTGCCTCCAGGCTCTGTC | 117 | 1092 |
| 1048069 | N/A | N/A | 6519 | 6538 | GGAGGTCCTCCCAGCCCCAT | 94 | 1093 |
| 1048085 | N/A | N/A | 6956 | 6975 | CCAGAACCTTCCACACTGAC | 79 | 1094 |
| 1048101 | N/A | N/A | 7069 | 7088 | ACTTTTCCCAACAACTGTGA | 84 | 1095 |
| 1048117 | N/A | N/A | 7388 | 7407 | CTGGCCCTTCTCCCCTGGCA | 81 | 1096 |

TABLE 15-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048133 | N/A | N/A | 7841 | 7860 | CAAGGCTGAAAAAGACTCAG | 121 | 1097 |
| 1048149 | N/A | N/A | 7985 | 8004 | AGGGTGACCCAAGTCCTTGG | 89 | 1098 |
| 1048165 | N/A | N/A | 8219 | 8238 | CAGGAAAGTCTAACTCCATC | 80 | 1099 |
| 1048181 | N/A | N/A | 9324 | 9343 | CACATTCACTAATATTTAAC | 93 | 21 |
| 1048197 | N/A | N/A | 9512 | 9531 | GCCTGGTTAGCCTTTCTGAT | 59 | 1100 |
| 1048213 | N/A | N/A | 9604 | 9623 | CCCTTTCCTCTTTCCTACTT | 71 | 1101 |
| 1048229 | N/A | N/A | 9727 | 9746 | TGTAAAATAAGGATGATGGG | 101 | 1102 |
| 1048245 | N/A | N/A | 9816 | 9835 | CAGAGCTCAAGAAGTCCCAA | 101 | 1103 |
| 1048261 | N/A | N/A | 10617 | 10636 | GGCTTCATTTCAGCCCCTCT | 73 | 1104 |
| 1048277 | N/A | N/A | 10702 | 10721 | GCCTAGGCTCTTCCAAACGG | 105 | 1105 |
| 1048293 | N/A | N/A | 10784 | 10803 | CCATCCTCTCCCATGCCCGG | 100 | 1106 |
| 1048309 | N/A | N/A | 10937 | 10956 | GGCCCAAATCCCTCCTTACC | 118 | 1107 |
| 1048325 | N/A | N/A | 11058 | 11077 | CTCTCCTCCAGAATTCCCTG | 76 | 1108 |
| 1048341 | N/A | N/A | 11149 | 11168 | TAGGATCCCATCTAGTGGCT | 51 | 1109 |
| 1048357 | N/A | N/A | 11316 | 11335 | TCCCATTCCCCTGGTAGTTT | 57 | 1110 |
| 1048373 | N/A | N/A | 11435 | 11454 | GGTGGTGAGATAACACTGGG | 88 | 1111 |
| 1048389 | N/A | N/A | 11608 | 11627 | GGACTCCTTAATGACCTGCA | 53 | 1112 |

TABLE 16

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047158 | 124 | 143 | 3572 | 3591 | GCCAGGCCCCCCACCATCAT | 102 | 1113 |
| 1047174 | 240 | 259 | 3688 | 3707 | TCTCCTTGAAGCCAGCATTG | 109 | 1114 |
| 1047190 | 477 | 496 | 3925 | 3944 | GATTGTCCCTCTCAACCTCC | 17* | 1115 |
| 1047206 | 563 | 582 | 4948 | 4967 | ATAGGCAGCCAGGTTGTTCT | 35* | 1116 |
| 1047222 | 638 | 657 | 5227 | 5246 | GATCTCCTCCTCCAGCGACT | 75 | 1117 |
| 1047238 | 809 | 828 | 5695 | 5714 | TTCGGCTTCATGCATGTTGC | 123 | 1118 |
| 1047254 | 1026 | 1045 | 7598 | 7617 | CCTCCTGATAACTGGCCGCC | 117 | 1119 |
| 1047270 | 1228 | 1247 | N/A | N/A | AGGCTGGTTTCTCGAATCTG | 117 | 1120 |
| 1047286 | 1286 | 1305 | 10900 | 10919 | CACGGTCTTCACCACGATGT | 89 | 1121 |
| 1047302 | 1348 | 1367 | 11637 | 11656 | CCTCACATCACATCCTTGTG | 103 | 1122 |
| 1047318 | 1413 | 1432 | 11702 | 11721 | AGCAACTATCCTGCTTCTGC | 58 | 1123 |
| 1047334 | 1612 | 1631 | 11901 | 11920 | GCTGGCCATGCCCCTCCAGA | 114 | 1124 |
| 1047350 | 1661 | 1680 | 11950 | 11969 | CCCCCGCCCTCCTCCCCTTC | 90 | 1125 |

TABLE 16-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047366 | 1731 | 1750 | 12020 | 12039 | AACCTCCATCTCTGGCAACA | 59 | 1126 |
| 1047382 | 1782 | 1801 | 12071 | 12090 | CTCCAGCAGCCTGAGGAAAC | 131 | 1127 |
| 1047398 | 1844 | 1863 | 12133 | 12152 | GCCTCTGGCCAGGGCTACCT | 100 | 1128 |
| 1047414 | 2034 | 2053 | 12323 | 12342 | TCCCCACCCATCTTAGACTG | 113 | 1129 |
| 1047430 | 2178 | 2197 | 12467 | 12486 | GCTGAGAATCAAGCTCCCAC | 54 | 1130 |
| 1047446 | 2235 | 2254 | 12524 | 12543 | CCCTCTATCCCTCCCAGCAC | 100 | 1131 |
| 1047462 | 2278 | 2297 | 12567 | 12586 | GGGCTTGACCTCTCTGTACC | 73 | 1132 |
| 1047478 | 2376 | 2395 | 12665 | 12684 | TCACCCACAACCCCTACTTG | 81 | 1133 |
| 1047494 | 2451 | 2470 | 12740 | 12759 | CTCTCCTGTTTCAGCATCTT | 61 | 1134 |
| 1047510 | 2481 | 2500 | 12770 | 12789 | ATGCCCTGCCCCCATGGATA | 83 | 1135 |
| 1047526 | 2777 | 2796 | 13066 | 13085 | CCCGGCCTCCAGGCTGCAGG | 89 | 1136 |
| 1047542 | 2859 | 2878 | 13148 | 13167 | CACAGATCCCACCAGTCTGC | 85 | 1137 |
| 1047558 | 2901 | 2920 | 13190 | 13209 | GAGGAGAACCCTGAAGTGGG | 95 | 1138 |
| 1047574 | 3018 | 3037 | 13307 | 13326 | AGCAGCAGTGCCCTGAAGAT | 78 | 1139 |
| 1047590 | 3055 | 3074 | 13344 | 13363 | CAGCATTTGTCTTTATTTTT | 21 | 1140 |
| 1047606 | N/A | N/A | 8758 | 8777 | ACCTTGTGATTTTCCCCGTC | 70 | 1141 |
| 1047622 | N/A | N/A | 9024 | 9043 | GTACAGTTACTCTGTACCAC | 138 | 1142 |
| 1047638 | N/A | N/A | 9066 | 9085 | GGACTCACCACCTTTACCAC | 68 | 1143 |
| 1047654 | N/A | N/A | 9200 | 9219 | GGATGAAAGAATAAAGCAGA | 85 | 1144 |
| 1047670 | N/A | N/A | 8377 | 8396 | CTGTACTGACCTCGAATCTG | 93 | 1145 |
| 1047686 | N/A | N/A | 8443 | 8462 | GTCTGGAGCAACCTACAGGC | 79 | 1146 |
| 1047702 | N/A | N/A | 8495 | 8514 | CACGAAGGCCCCAGGGAGA | 77 | 1147 |
| 1047718 | N/A | N/A | 8633 | 8652 | AAGCTCTCACCCAGTTCTGC | 108 | 1148 |
| 1047734 | N/A | N/A | 8733 | 8752 | TGCTTTTGCCCCCTGTAGTG | 47 | 1149 |
| 1047750 | N/A | N/A | 4090 | 4109 | TAGTGCCCCATCAAGAGGTA | 88 | 1150 |
| 1047766 | N/A | N/A | 4262 | 4281 | TCACAAAGCCCAGCCATGAA | 89 | 1151 |
| 1047782 | N/A | N/A | 4319 | 4338 | TCCAACTCCTCCTTTATATG | 85 | 1152 |
| 1047798 | N/A | N/A | 4357 | 4376 | GAATCCAATCTCCCTCATGG | 94 | 1153 |
| 1047814 | N/A | N/A | 4396 | 4415 | CCAGACCTGCCTGCTCTTTC | 89 | 1154 |
| 1047830 | N/A | N/A | 4523 | 4542 | TCCTCTGATCCCAGGTAACC | 76 | 1155 |
| 1047846 | N/A | N/A | 4701 | 4720 | TAACTCATTACTAAGGTGCC | 79 | 1156 |
| 1047862 | N/A | N/A | 4804 | 4823 | GACCACCCCACCCAGGACC | 105 | 1157 |
| 1047878 | N/A | N/A | 4853 | 4872 | AGGACACTTGAATACCTGCC | 56 | 1158 |
| 1047894 | N/A | N/A | 5004 | 5023 | GCCATCAATCCTTTCCTCCC | 100 | 1159 |
| 1047910 | N/A | N/A | 5113 | 5132 | AGGCTCCTTCTCCCCATTCC | 90 | 1160 |
| 1047926 | N/A | N/A | 5379 | 5398 | CTGCCAATCTCTGTTTCTCT | 85 | 1161 |

TABLE 16-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
| --- | --- | --- | --- | --- | --- | --- | --- |
| 1047942 | N/A | N/A | 5496 | 5515 | TTCCCCACGCCATTGTGTCC | 76 | 1162 |
| 1047958 | N/A | N/A | 5787 | 5806 | TCCTTCCCCATTCTCTTGT | 121 | 1163 |
| 1047974 | N/A | N/A | 5851 | 5870 | CCATCTCACTTCTCTGGTGA | 82 | 1164 |
| 1047990 | N/A | N/A | 6019 | 6038 | CGGCTCTCTCATCTGTCAAA | 43 | 1165 |
| 1048006 | N/A | N/A | 6115 | 6134 | GCAGGCTCCCAAGTGAGATG | 99 | 1166 |
| 1048022 | N/A | N/A | 6221 | 6240 | CGTCAATATCACACCTTCCA | 96 | 1167 |
| 1048038 | N/A | N/A | 6324 | 6343 | CCTGCCTAGCCCAAATGCCC | 119 | 1168 |
| 1048054 | N/A | N/A | 6400 | 6419 | GCTTTTCTGCCTCCAGGCTC | 77 | 1169 |
| 1048070 | N/A | N/A | 6539 | 6558 | CCTTTCTCCCCTGCCTGCAG | 89 | 1170 |
| 1048086 | N/A | N/A | 6957 | 6976 | TCCAGAACCTTCCACACTGA | 82 | 1171 |
| 1048102 | N/A | N/A | 7070 | 7089 | GACTTTTCCCAACAACTGTG | 84 | 1172 |
| 1048118 | N/A | N/A | 7390 | 7409 | CCCTGGCCCTTCTCCCCTGG | 76 | 1173 |
| 1048134 | N/A | N/A | 7842 | 7861 | ACAAGGCTGAAAAAGACTCA | 83 | 1174 |
| 1048150 | N/A | N/A | 7986 | 8005 | GAGGGTGACCCAAGTCCTTG | 110 | 1175 |
| 1048166 | N/A | N/A | 8221 | 8240 | GCCAGGAAAGTCTAACTCCA | 75 | 1176 |
| 1048182 | N/A | N/A | 9326 | 9345 | GTCACATTCACTAATATTTA | 44 | 1177 |
| 1048198 | N/A | N/A | 9525 | 9544 | CCTCTACTAGTCAGCCTGGT | 65 | 1178 |
| 1048214 | N/A | N/A | 9606 | 9625 | TCCCCTTTCCTCTTTCCTAC | 75 | 1179 |
| 1048230 | N/A | N/A | 9772 | 9791 | CTCTGGGCAAGTTAATTGAC | 122 | 1180 |
| 1048246 | N/A | N/A | 9818 | 9837 | ACCAGAGCTCAAGAAGTCCC | 83 | 1181 |
| 1048262 | N/A | N/A | 10618 | 10637 | TGGCTTCATTTCAGCCCCTC | 81 | 1182 |
| 1048278 | N/A | N/A | 10710 | 10729 | CAGAGAGAGCCTAGGCTCTT | 95 | 1183 |
| 1048294 | N/A | N/A | 10788 | 10807 | TGAGCCATCCTCTCCCATGC | 125 | 1184 |
| 1048310 | N/A | N/A | 10940 | 10959 | CTGGGCCCAAATCCCTCCTT | 83 | 1185 |
| 1048326 | N/A | N/A | 11060 | 11079 | TGCTCTCCTCCAGAATTCCC | 123 | 1186 |
| 1048342 | N/A | N/A | 11223 | 11242 | CTAACTTTAATTCTCTTTCT | 114 | 1187 |
| 1048358 | N/A | N/A | 11317 | 11336 | TTCCCATTCCCTGGTAGTT | 89 | 1188 |
| 1048374 | N/A | N/A | 11436 | 11455 | GGGTGGTGAGATAACACTGG | 106 | 1189 |
| 1048390 | N/A | N/A | 11609 | 11628 | TGGACTCCTTAATGACCTGC | 68 | 1190 |

TABLE 17

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047159 | 126 | 145 | 3574 | 3593 | GAGCCAGGCCCCCCACCATC | 104 | 1191 |
| 1047175 | 244 | 263 | 3692 | 3711 | CGGGTCTCCTTGAAGCCAGC | 125 | 1192 |
| 1047191 | 480 | 499 | 3928 | 3947 | CCAGATTGTCCCTCTCAACC | 15* | 1193 |
| 1047207 | 574 | 593 | N/A | N/A | GCTTCCTGTCTATAGGCAGC | 37* | 1194 |
| 1047223 | 639 | 658 | 5228 | 5247 | GGATCTCCTCCTCCAGCGAC | 79 | 1195 |
| 1047239 | 811 | 830 | 5697 | 5716 | TCTTCGGCTTCATGCATGTT | 98 | 1196 |
| 1047255 | 1028 | 1047 | 7600 | 7619 | CGCCTCCTGATAACTGGCCG | 105 | 1197 |
| 1047271 | 1241 | 1260 | 10855 | 10874 | AGACTTGGTGTCCAGGCTGG | 79 | 1198 |
| 1047287 | 1289 | 1308 | 10903 | 10922 | CTCCACGGTCTTCACCACGA | 138 | 1199 |
| 1047303 | 1349 | 1368 | 11638 | 11657 | GCCTCACATCACATCCTTGT | 113 | 1200 |
| 1047319 | 1414 | 1433 | 11703 | 11722 | GAGCAACTATCCTGCTTCTG | 68 | 1201 |
| 1047335 | 1615 | 1634 | 11904 | 11923 | GCTGCTGGCCATGCCCCTCC | 123 | 1202 |
| 1047351 | 1663 | 1682 | 11952 | 11971 | GCCCCCCGCCCTCCTCCCCT | 73 | 1203 |
| 1047367 | 1734 | 1753 | 12023 | 12042 | GAGAACCTCCATCTCTGGCA | 67 | 1204 |
| 1047383 | 1790 | 1809 | 12079 | 12098 | CAGTTTTCCTCCAGCAGCCT | 109 | 11 |
| 1047399 | 1853 | 1872 | 12142 | 12161 | ACAAAACAAGCCTCTGGCCA | 90 | 1206 |
| 1047415 | 2035 | 2054 | 12324 | 12343 | GTCCCCACCCATCTTAGACT | 76 | 1207 |
| 1047431 | 2179 | 2198 | 12468 | 12487 | TGCTGAGAATCAAGCTCCCA | 91 | 1208 |
| 1047447 | 2236 | 2255 | 12525 | 12544 | CCCCTCTATCCCTCCCAGCA | 83 | 1209 |
| 1047463 | 2279 | 2298 | 12568 | 12587 | TGGGCTTGACCTCTCTGTAC | 103 | 1210 |
| 1047479 | 2377 | 2396 | 12666 | 12685 | GTCACCCACAACCCCTACTT | 88 | 1211 |
| 1047495 | 2456 | 2475 | 12745 | 12764 | CCTTTCTCTCCTGTTTCAGC | 54 | 1212 |
| 1047511 | 2482 | 2501 | 12771 | 12790 | CATGCCCTGCCCCCATGGAT | 83 | 1213 |
| 1047527 | 2779 | 2798 | 13068 | 13087 | CACCCGGCCTCCAGGCTGCA | 106 | 1214 |
| 1047543 | 2860 | 2879 | 13149 | 13168 | GCACAGATCCCACCAGTCTG | 108 | 1215 |
| 1047559 | 2902 | 2921 | 13191 | 13210 | AGAGGAGAACCCTGAAGTGG | 120 | 1216 |
| 1047575 | 3034 | 3053 | 13323 | 13342 | CTCAGCGACTAAAGGCAGCA | 59 | 1217 |
| 1047591 | 3056 | 3075 | 13345 | 13364 | GCAGCATTTGTCTTTATTTT | 22 | 1218 |
| 1047607 | N/A | N/A | 8760 | 8779 | TGACCTTGTGATTTTCCCCG | 59 | 1219 |
| 1047623 | N/A | N/A | 9025 | 9044 | TGTACAGTTACTCTGTACCA | 103 | 1220 |
| 1047639 | N/A | N/A | 9067 | 9086 | AGGACTCACCACCTTTACCA | 77 | 1221 |
| 1047655 | N/A | N/A | 9201 | 9220 | GGGATGAAAGAATAAAGCAG | 67 | 1222 |
| 1047671 | N/A | N/A | 8378 | 8397 | GCTGTACTGACCTCGAATCT | 94 | 1223 |
| 1047687 | N/A | N/A | 8453 | 8472 | CTCAGTCCCAGTCTGGAGCA | 123 | 1224 |
| 1047703 | N/A | N/A | 8502 | 8521 | GCAGTGTCACGAAGGCCCCC | 89 | 1225 |
| 1047719 | N/A | N/A | 8635 | 8654 | TCAAGCTCTCACCCAGTTCT | 96 | 1226 |

TABLE 17-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047735 | N/A | N/A | 8735 | 8754 | GGTGCTTTTGCCCCCTGTAG | 55 | 1227 |
| 1047751 | N/A | N/A | 4091 | 4110 | ATAGTGCCCCATCAAGAGGT | 135 | 1228 |
| 1047767 | N/A | N/A | 4263 | 4282 | GTCACAAAGCCCAGCCATGA | 122 | 1229 |
| 1047783 | N/A | N/A | 4321 | 4340 | CTTCCAACTCCTCCTTTATA | 95 | 1230 |
| 1047799 | N/A | N/A | 4358 | 4377 | AGAATCCAATCTCCCTCATG | 67 | 1231 |
| 1047815 | N/A | N/A | 4399 | 4418 | CGCCCAGACCTGCCTGCTCT | 94 | 1232 |
| 1047831 | N/A | N/A | 4524 | 4543 | TTCCTCTGATCCCAGGTAAC | 86 | 1233 |
| 1047847 | N/A | N/A | 4702 | 4721 | TTAACTCATTACTAAGGTGC | 87 | 1234 |
| 1047863 | N/A | N/A | 4805 | 4824 | AGACCACCCCACCCAGGAC | 96 | 1235 |
| 1047879 | N/A | N/A | 4866 | 4885 | CCAGGCTCTTCTGAGGACAC | 119 | 1236 |
| 1047895 | N/A | N/A | 5005 | 5024 | GGCCATCAATCCTTTCCTCC | 81 | 1237 |
| 1047911 | N/A | N/A | 5115 | 5134 | CCAGGCTCCTTCTCCCCATT | 92 | 1238 |
| 1047927 | N/A | N/A | 5385 | 5404 | CTCTACCTGCCAATCTCTGT | 86 | 1239 |
| 1047943 | N/A | N/A | 5497 | 5516 | GTTCCCCACGCCATTGTGTC | 78 | 1240 |
| 1047959 | N/A | N/A | 5788 | 5807 | CTCCTTCCCCCATTCTCTTG | 104 | 1241 |
| 1047975 | N/A | N/A | 5933 | 5952 | GCTACTACTAATAATAGCAA | 99 | 1242 |
| 1047991 | N/A | N/A | 6021 | 6040 | TTCGGCTCTCTCATCTGTCA | 80 | 1243 |
| 1048007 | N/A | N/A | 6117 | 6136 | ATGCAGGCTCCCAAGTGAGA | 88 | 1244 |
| 1048023 | N/A | N/A | 6280 | 6299 | CCACACTACATATAAGCTCT | 163 | 1245 |
| 1048039 | N/A | N/A | 6325 | 6344 | TCCTGCCTAGCCCAAATGCC | 100 | 1246 |
| 1048055 | N/A | N/A | 6403 | 6422 | TGTGCTTTTCTGCCTCCAGG | 52 | 1247 |
| 1048071 | N/A | N/A | 6543 | 6562 | TAGCCCTTTCTCCCCTGCCT | 77 | 1248 |
| 1048087 | N/A | N/A | 6958 | 6977 | ATCCAGAACCTTCCACACTG | 88 | 1249 |
| 1048103 | N/A | N/A | 7072 | 7091 | GGGACTTTTCCCAACAACTG | 68 | 1250 |
| 1048119 | N/A | N/A | 7393 | 7412 | CGTCCCTGGCCCTTCTCCCC | 77 | 1251 |
| 1048135 | N/A | N/A | 7843 | 7862 | CACAAGGCTGAAAAAGACTC | 94 | 1252 |
| 1048151 | N/A | N/A | 7987 | 8006 | GGAGGGTGACCCAAGTCCTT | 35 | 1253 |
| 1048167 | N/A | N/A | 8222 | 8241 | TGCCAGGAAAGTCTAACTCC | 77 | 1254 |
| 1048183 | N/A | N/A | 9362 | 9381 | TCCCCCCGCCCCGCCCGAGA | 88 | 1255 |
| 1048199 | N/A | N/A | 9533 | 9552 | CAGTATTACCTCTACTAGTC | 64 | 20 |
| 1048215 | N/A | N/A | 9609 | 9628 | CTGTCCCCTTTCCTCTTTCC | 98 | 1256 |
| 1048231 | N/A | N/A | 9788 | 9807 | CCAACCAGCCACATGACTCT | 91 | 1257 |
| 1048247 | N/A | N/A | 9825 | 9844 | TCAGGAGACCAGAGCTCAAG | 93 | 1258 |
| 1048263 | N/A | N/A | 10620 | 10639 | CCTGGCTTCATTTCAGCCCC | 87 | 1259 |
| 1048279 | N/A | N/A | 10711 | 10730 | GCAGAGAGAGCCTAGGCTCT | 143 | 1260 |
| 1048295 | N/A | N/A | 10792 | 10811 | GGCATGAGCCATCCTCTCCC | 123 | 1261 |

TABLE 17-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048311 | N/A | N/A | 10941 | 10960 | ACTGGGCCCAAATCCCTCCT | 104 | 1262 |
| 1048327 | N/A | N/A | 11061 | 11080 | TTGCTCTCCTCCAGAATTCC | 97 | 1263 |
| 1048343 | N/A | N/A | 11226 | 11245 | CTACTAACTTTAATTCTCTT | 97 | 1264 |
| 1048359 | N/A | N/A | 11318 | 11337 | CTTCCCATTCCCCTGGTAGT | 86 | 1265 |
| 1048375 | N/A | N/A | 11487 | 11506 | GTCTTACTTTTCTTGATAGT | 94 | 1266 |
| 1048391 | N/A | N/A | 11610 | 11629 | TTGGACTCCTTAATGACCTG | 86 | 1267 |

Example 2: Effect of 5-10-5 MOE Gapmer Modified Oligonucleotides on Human GFAP RNA In Vitro, Single Dose Modified oligonucleotides complementary to human GFAP nucleic acid were designed and tested for their single dose effects on GFAP RNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-β-D-deoxynucleosides and the 5' and 3' wing segments each consists of five 2'-β-D-MOE modified nucleosides. The sugar motif for the gapmers is (from 5' to 3'): eeeeedddddddddeeeee; wherein 'd' represents a 2'-β-D-deoxyribosyl sugar moiety, and 'e' represents a 2'-β-D-MOE sugar moiety. The internucleoside linkage motif for the gapmers is (from 5' to 3'): sooosssssssssssooss; wherein each 'o' represents a phosphodiester internucleoside linkage and each 's' represents a phosphorothioate internucleoside linkage. Each cytosine residue is a 5-methylcytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the Tables below is 100% complementary to SEQ ID NO: 1, SEQ ID NO: 2, or SEQ ID NO: 3 (GENBANK Accession No. NM_001131019.2). 'N/A' indicates that the modified oligonucleotide is not 100% complementary to that particular gene sequence.

Cultured U251 cells were treated with modified oligonucleotide at a concentration of 4,000 nM using free uptake at a density of 10,000 cells per well. After a treatment period of approximately 48 hours, total RNA was isolated from the cells and GFAP RNA levels were measured by quantitative real-time RTPCR. Human GFAP primer probe set RTS37485, described in Example 1 above, was used to measure RNA levels. GFAP RNA levels were normalized to total RNA content, as measured by RIBOGREEN®. Results are presented in the tables below as percent GFAP RNA levels relative to untreated control cells. The values marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 18

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (%UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1072810 | 1708 | 1727 | 11997 | 12016 | TCCATAACAACAGGAATCAG | 65 | 1268 |
| 1072814 | 1719 | 1738 | 12008 | 12027 | TGGCAACAGTTTCCATAACA | 31 | 1269 |
| 1072818 | 1728 | 1747 | 12017 | 12036 | CTCCATCTCTGGCAACAGTT | 42 | 1270 |
| 1072822 | 1752 | 1771 | 12041 | 12060 | AGTTCCCAGATACTCCGAGA | 56 | 1271 |
| 1072826 | 1763 | 1782 | 12052 | 12071 | CTCAAAGGCACAGTTCCCAG | 56 | 1272 |
| 1072830 | 1786 | 1805 | 12075 | 12094 | TTTCCTCCAGCAGCCTGAGG | 79 | 1273 |
| 1072834 | 1796 | 1815 | 12085 | 12104 | GAGTCTCAGTTTTCCTCCAG | 18 | 1274 |

TABLE 18-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (%UTC) | SEQ ID NO |
|---|---|---|---|---|---|---|---|
| 1072838 | 2173 | 2192 | 12462 | 12481 | GAATCAAGCTCCCACCTGCC | 87 | 1275 |
| 1072842 | 2177 | 2196 | 12466 | 12485 | CTGAGAATCAAGCTCCCACC | 94 | 1276 |
| 1072846 | 3039 | 3058 | 13328 | 13347 | TTTTCCTCAGCGACTAAAGG | 48 | 1277 |
| 1072850 | 3059 | 3078 | 13348 | 13367 | GGCGCAGCATTTGTCTTTAT | 45 | 1278 |
| 1072854 | N/A | N/A | 8768 | 8787 | ATATCTTGTGACCTTGTGAT | 53 | 1279 |
| 1072858 | N/A | N/A | 8774 | 8793 | TTTGAGATATCTTGTGACCT | 66 | 1280 |
| 1072862 | N/A | N/A | 8780 | 8799 | GAGGCTTTTGAGATATCTTG | 28 | 1281 |
| 1072866 | N/A | N/A | 8785 | 8804 | ATTGTGAGGCTTTTGAGATA | 66 | 1282 |
| 1072870 | N/A | N/A | 7980 | 7999 | GACCCAAGTCCTTGGCCTTG | 81 | 1283 |
| 1072874 | N/A | N/A | 7990 | 8009 | TTTGGAGGGTGACCCAAGTC | 78 | 1284 |
| 1072878 | N/A | N/A | 7997 | 8016 | CTCTTAGTTTGGAGGGTGAC | 61 | 1285 |
| 1072882 | N/A | N/A | 11296 | 11315 | CCTTTTACCAAGCTGGAAAT | 73 | 1286 |
| 1072886 | N/A | N/A | 11303 | 11322 | GTAGTTTCCTTTTACCAAGC | 34 | 1287 |
| 1072890 | N/A | N/A | 4033 | 4052 | GAGACTTCTCGGGCACTCCT | 75 | 1288 |
| 1072894 | N/A | N/A | 4133 | 4152 | TGGGCCTGTTTCTGGTCCCT | 63 | 1289 |
| 1072898 | N/A | N/A | 4208 | 4227 | TTCCCCAGTAGGGAGGTGCT | 100 | 1290 |
| 1072902 | N/A | N/A | 4285 | 4304 | ATAGGTGAGCTCGCTGCCCA | 82 | 1291 |
| 1072906 | N/A | N/A | 4297 | 4316 | CACAGGCTCAGAATAGGTGA | 68 | 1292 |
| 1072910 | N/A | N/A | 4458 | 4477 | CAAGTCAAAGTAACTTGATG | 80 | 1293 |
| 1072914 | N/A | N/A | 4492 | 4511 | TGAATTTTATTATGACCACC | 64 | 1294 |
| 1072918 | N/A | N/A | 4564 | 4583 | CATGTCCTGTCAGCTCAGTG | 61 | 1295 |
| 1072922 | N/A | N/A | 4638 | 4657 | CACAAGCATACACTCACTGT | 84 | 1296 |
| 1072926 | N/A | N/A | 4677 | 4696 | CAGGGTTGGTGCACCTGCTT | 74 | 1297 |
| 1072930 | N/A | N/A | 4748 | 4767 | TAGACAGAGGACTTGTCTGG | 96 | 1298 |
| 1072934 | N/A | N/A | 4826 | 4845 | CCCTTGAGGCAGCTGTCACA | 87 | 1299 |
| 1072938 | N/A | N/A | 5049 | 5068 | CATTGCTCTGGCGGGCTGAG | 89 | 1300 |
| 1072942 | N/A | N/A | 5296 | 5315 | CAATCTCTGTGTTGAGCTTT | 70 | 1301 |
| 1072946 | N/A | N/A | 5396 | 5415 | TCATTTCCTGTCTCTACCTG | 85 | 1302 |
| 1072950 | N/A | N/A | 5549 | 5568 | GACCAGGGTGAGAGAAGCGG | 78 | 1303 |
| 1072954 | N/A | N/A | 5745 | 5764 | GAGGAGGCAGGCTGGCCCAC | 84 | 1304 |
| 1072958 | N/A | N/A | 5900 | 5919 | AATAATGGGTACTTTTGAAA | 88 | 1305 |
| 1072962 | N/A | N/A | 5986 | 6005 | TTCATAGTAAGGTAATCCAT | 75 | 1306 |
| 1072966 | N/A | N/A | 6032 | 6051 | CCTCTCTGGACTTCGGCTCT | 81 | 1307 |
| 1072970 | N/A | N/A | 6240 | 6259 | GGCACTATGTTTGGGTGCAC | 85 | 1308 |
| 1072974 | N/A | N/A | 6302 | 6321 | TCTACAGTGTCTTTCCTGGC | 67 | 1309 |
| 1072978 | N/A | N/A | 6446 | 6465 | CTAGGTGCCCTGGCTAGGCT | 72 | 1310 |

TABLE 18-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (%UTC) | SEQ ID NO |
|---|---|---|---|---|---|---|---|
| 1072982 | N/A | N/A | 6524 | 6543 | TGCAGGGAGGTCCTCCCAGC | 96 | 1311 |
| 1072986 | N/A | N/A | 6901 | 6920 | GCGAGCGGAGGCCTGGGTGT | 26 | 1312 |
| 1072990 | N/A | N/A | 6942 | 6961 | ACTGACAGCTGCATCTGCGG | 79 | 1313 |
| 1072994 | N/A | N/A | 6985 | 7004 | AAGCGAATGAATGAACAGTG | 69 | 1314 |
| 1072998 | N/A | N/A | 7079 | 7098 | CCTGGCTGGGACTTTTCCCA | 84 | 1315 |
| 1073002 | N/A | N/A | 7119 | 7138 | GGGAGGTGAGCAGCACCCCA | 84 | 1316 |
| 1073006 | N/A | N/A | 7358 | 7377 | TGGCCGTCCCTGCTCCGCCC | 96 | 1317 |
| 1073010 | N/A | N/A | 7510 | 7529 | GGCCGGTCCCGCGGAGCCCC | 86 | 1318 |
| 1073014 | N/A | N/A | 7521 | 7540 | GGGATGGAGCCGGCCGGTCC | 77 | 1319 |
| 1073018 | N/A | N/A | 7785 | 7804 | AGCAGGGAGACTTCCCCAGG | 85 | 1320 |
| 1073022 | N/A | N/A | 7827 | 7846 | ACTCAGTCCCTGAAGGGAGC | 90 | 1321 |
| 1073026 | N/A | N/A | 7898 | 7917 | CTGCTATGTGTGAGGCAGGC | 83 | 1322 |
| 1073030 | N/A | N/A | 8027 | 8046 | CAATCTTGGCTGGGAAGATG | 90 | 1323 |
| 1073034 | N/A | N/A | 8048 | 8067 | AGATGGGTGAGGTGAGGAGT | 33 | 1324 |
| 1073038 | N/A | N/A | 8231 | 8250 | CCTTTTCCTTGCCAGGAAAG | 76 | 1325 |
| 1073042 | N/A | N/A | 9380 | 9399 | AGTAATTTAGCTCCCCCCTC | 76 | 1326 |
| 1073046 | N/A | N/A | 9410 | 9429 | AGAATCATTTCAGGGCCAAT | 67 | 1327 |
| 1073050 | N/A | N/A | 9438 | 9457 | GAAGAAGAGGAATTTTGTTC | 82 | 1328 |
| 1073054 | N/A | N/A | 9486 | 9505 | TTAAGTCCTGAGACATGCAT | 55 | 1329 |
| 1073058 | N/A | N/A | 9500 | 9519 | TTTCTGATGCTGAATTAAGT | 88 | 1330 |
| 1073062 | N/A | N/A | 9543 | 9562 | TAGGATTTGGCAGTATTACC | 62 | 1331 |
| 1073066 | N/A | N/A | 9649 | 9668 | TGTGGCACATATTAGTGCTC | 76 | 1332 |
| 1073070 | N/A | N/A | 10001 | 10020 | AATCCCCTTACTCGGGAGTC | 76 | 1333 |
| 1073074 | N/A | N/A | 10551 | 10570 | TTGAAATCAGGAGACCAGGA | 73 | 1334 |
| 1073078 | N/A | N/A | 10567 | 10586 | AAAACCCAGCACGGTATTGA | 73 | 1335 |
| 1073082 | N/A | N/A | 10715 | 10734 | CCGAGCAGAGAGAGCCTAGG | 88 | 1336 |
| 1073086 | N/A | N/A | 10805 | 10824 | CATGGACTTTCAGGGCATGA | 90 | 1337 |
| 1073090 | N/A | N/A | 11105 | 11124 | CAGCCTATGGAGGGACTGAG | 88 | 1338 |
| 1073094 | N/A | N/A | 11165 | 11184 | AAGAGAGAGTGTGTATTAGG | 63 | 1339 |
| 1073098 | N/A | N/A | 11208 | 11227 | TTTCTCTCCCTGGCAAGCAA | 65 | 1340 |
| 1073102 | N/A | N/A | 11256 | 11275 | AACTGTGTCTGCTAGAGTTG | 66 | 1341 |
| 1073106 | N/A | N/A | 11386 | 11405 | GTAAGCTGCTGGAGTAAGAT | 45 | 1342 |
| 1073110 | N/A | N/A | 11472 | 11491 | ATAGTAACCACAGCTGCCTT | 81 | 1343 |
| 1073114 | N/A | N/A | 11516 | 11535 | GTAACCTTGGGAAGTCCCCG | 75 | 1344 |

TABLE 19

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1072811 | 1711 | 1730 | 12000 | 12019 | GTTTCCATAACAACAGGAAT | 82 | 1345 |
| 1072815 | 1720 | 1739 | 12009 | 12028 | CTGGCAACAGTTTCCATAAC | 40 | 1346 |
| 1072819 | 1746 | 1765 | 12035 | 12054 | CAGATACTCCGAGAGAACCT | 75 | 1347 |
| 1072823 | 1753 | 1772 | 12042 | 12061 | CAGTTCCCAGATACTCCGAG | 65 | 1348 |
| 1072827 | 1766 | 1785 | 12055 | 12074 | AAACTCAAAGGCACAGTTCC | 99 | 1349 |
| 1072831 | 1787 | 1806 | 12076 | 12095 | TTTTCCTCCAGCAGCCTGAG | 85 | 1350 |
| 1072835 | 1797 | 1816 | 12086 | 12105 | TGAGTCTCAGTTTTCCTCCA | 18 | 1351 |
| 1072839 | 2174 | 2193 | 12463 | 12482 | AGAATCAAGCTCCCACCTGC | 82 | 1352 |
| 1072843 | 3036 | 3055 | 13325 | 13344 | TCCTCAGCGACTAAAGGCAG | 54 | 1353 |
| 1072847 | 3041 | 3060 | 13330 | 13349 | ATTTTTCCTCAGCGACTAAA | 55 | 1354 |
| 1072851 | 3061 | 3080 | 13350 | 13369 | AGGGCGCAGCATTTGTCTTT | 55 | 1355 |
| 1072855 | N/A | N/A | 8771 | 8790 | GAGATATCTTGTGACCTTGT | 37 | 1356 |
| 1072859 | N/A | N/A | 8775 | 8794 | TTTTGAGATATCTTGTGACC | 60 | 1357 |
| 1072863 | N/A | N/A | 8781 | 8800 | TGAGGCTTTTGAGATATCTT | 34 | 1358 |
| 1072867 | N/A | N/A | 8786 | 8805 | TATTGTGAGGCTTTTGAGAT | 60 | 1359 |
| 1072871 | N/A | N/A | 7983 | 8002 | GGTGACCCAAGTCCTTGGCC | 76 | 1360 |
| 1072875 | N/A | N/A | 7991 | 8010 | GTTTGGAGGGTGACCCAAGT | 70 | 1361 |
| 1072879 | N/A | N/A | 11290 | 11309 | ACCAAGCTGGAAATGGAAAG | 70 | 1362 |
| 1072883 | N/A | N/A | 11297 | 11316 | TCCTTTTACCAAGCTGGAAA | 83 | 1363 |
| 1072887 | N/A | N/A | 11304 | 11323 | GGTAGTTTCCTTTTACCAAG | 49 | 1364 |
| 1072891 | N/A | N/A | 4035 | 4054 | CTGAGACTTCTCGGGCACTC | 87 | 1365 |
| 1072895 | N/A | N/A | 4162 | 4181 | GGCATGCGGGCATCAGATCC | 87 | 1366 |
| 1072899 | N/A | N/A | 4221 | 4240 | CTCCTGCACTGCTTTCCCCA | 64 | 1367 |
| 1072903 | N/A | N/A | 4287 | 4306 | GAATAGGTGAGCTCGCTGCC | 89 | 1368 |
| 1072907 | N/A | N/A | 4304 | 4323 | ATATGGACACAGGCTCAGAA | 79 | 1369 |
| 1072911 | N/A | N/A | 4463 | 4482 | CTGTGCAAGTCAAAGTAACT | 76 | 1370 |
| 1072915 | N/A | N/A | 4493 | 4512 | ATGAATTTTATTATGACCAC | 67 | 1371 |
| 1072919 | N/A | N/A | 4581 | 4600 | ACTTGAAGGCACACATGCAT | 70 | 1372 |
| 1072923 | N/A | N/A | 4648 | 4667 | CAGGCGCATCCACAAGCATA | 88 | 1373 |
| 1072927 | N/A | N/A | 4732 | 4751 | CTGGAGGATGAGCAGATGTG | 57 | 1374 |
| 1072931 | N/A | N/A | 4779 | 4798 | AGCAGCAGGAGGATTAAGGG | 68 | 1375 |
| 1072935 | N/A | N/A | 4827 | 4846 | TCCCTTGAGGCAGCTGTCAC | 96 | 1376 |
| 1072939 | N/A | N/A | 5058 | 5077 | GGAGCAGCACATTGCTCTGG | 80 | 1377 |
| 1072943 | N/A | N/A | 5299 | 5318 | TTGCAATCTCTGTGTTGAGC | 55 | 1378 |
| 1072947 | N/A | N/A | 5452 | 5471 | AGTTCGAATGCTCTCTTGTC | 78 | 1379 |

TABLE 19-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072951 | N/A | N/A | 5715 | 5734 | ACCTTGGAGCGGTACCACTC | 111 | 1380 |
| 1072955 | N/A | N/A | 5828 | 5847 | TCAGTCACCTGGAGAGGATA | 58 | 1381 |
| 1072959 | N/A | N/A | 5918 | 5937 | AGCAATAGTAGCAGTAATAA | 82 | 1382 |
| 1072963 | N/A | N/A | 5987 | 6006 | CTTCATAGTAAGGTAATCCA | 84 | 1383 |
| 1072967 | N/A | N/A | 6122 | 6141 | ATGGAATGCAGGCTCCCAAG | 71 | 1384 |
| 1072971 | N/A | N/A | 6251 | 6270 | TGTTCTCTACGGGCACTATG | 58 | 1385 |
| 1072975 | N/A | N/A | 6374 | 6393 | CCACTAGGAATGGCCCTCCC | 61 | 1386 |
| 1072979 | N/A | N/A | 6451 | 6470 | CTCAGCTAGGTGCCCTGGCT | 80 | 1387 |
| 1072983 | N/A | N/A | 6561 | 6580 | CCTCACCCTGGGTTCTAATA | 83 | 1388 |
| 1072987 | N/A | N/A | 6903 | 6922 | AGGCGAGCGGAGGCCTGGGT | 97 | 1389 |
| 1072991 | N/A | N/A | 6944 | 6963 | ACACTGACAGCTGCATCTGC | 79 | 1390 |
| 1072995 | N/A | N/A | 6997 | 7016 | CACCTGGTCAGCAAGCGAAT | 78 | 1391 |
| 1072999 | N/A | N/A | 7082 | 7101 | GGCCCTGGCTGGGACTTTTC | 79 | 1392 |
| 1073003 | N/A | N/A | 7125 | 7144 | AAATCAGGGAGGTGAGCAGC | 46 | 1393 |
| 1073007 | N/A | N/A | 7382 | 7401 | CTTCTCCCCTGGCATCTCCT | 77 | 1394 |
| 1073011 | N/A | N/A | 7517 | 7536 | TGGAGCCGGCCGGTCCCGCG | 87 | 1395 |
| 1073015 | N/A | N/A | 7757 | 7776 | TGAGGGCTCACCGGTTCTCC | 81 | 1396 |
| 1073019 | N/A | N/A | 7789 | 7808 | AGGCAGCAGGGAGACTTCCC | 88 | 1397 |
| 1073023 | N/A | N/A | 7855 | 7874 | AAGGGATCTGCACACAAGGC | 79 | 1398 |
| 1073027 | N/A | N/A | 7924 | 7943 | TCAGTCATCAAACATCTAGT | 78 | 1399 |
| 1073031 | N/A | N/A | 8028 | 8047 | CCAATCTTGGCTGGGAAGAT | 66 | 1400 |
| 1073035 | N/A | N/A | 8051 | 8070 | AAGAGATGGGTGAGGTGAGG | 36 | 1401 |
| 1073039 | N/A | N/A | 8274 | 8293 | TAGGCTGGGTCTTGGTGCGG | 76 | 1402 |
| 1073043 | N/A | N/A | 9381 | 9400 | AAGTAATTTAGCTCCCCCCT | 76 | 1403 |
| 1073047 | N/A | N/A | 9411 | 9430 | AAGAATCATTTCAGGGCCAA | 54 | 1404 |
| 1073051 | N/A | N/A | 9440 | 9459 | CAGAAGAAGAGGAATTTTGT | 70 | 1405 |
| 1073055 | N/A | N/A | 9487 | 9506 | ATTAAGTCCTGAGACATGCA | 64 | 1406 |
| 1073059 | N/A | N/A | 9502 | 9521 | CCTTTCTGATGCTGAATTAA | 72 | 1407 |
| 1073063 | N/A | N/A | 9552 | 9571 | GTGACTATCTAGGATTTGGC | 23 | 1408 |
| 1073067 | N/A | N/A | 9685 | 9704 | GAGGAGACAATTAACTAAAA | 64 | 1409 |
| 1073071 | N/A | N/A | 10125 | 10144 | TCGAAAGCAGGCAAGCAAGC | 99 | 1410 |
| 1073075 | N/A | N/A | 10552 | 10571 | ATTGAAATCAGGAGACCAGG | 66 | 1411 |
| 1073079 | N/A | N/A | 10612 | 10631 | CATTTCAGCCCCTCTGCAAG | 77 | 1412 |
| 1073083 | N/A | N/A | 10724 | 10743 | CCTATGCAACCGAGCAGAGA | 95 | 1413 |
| 1073087 | N/A | N/A | 10848 | 10867 | GTGTCCAGGCTGGTTTCTGC | 82 | 1414 |
| 1073091 | N/A | N/A | 11124 | 11143 | ACCAAGGCTCCCCTTAGAAC | 59 | 1415 |

TABLE 19-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1073095 | N/A | N/A | 11166 | 11185 | AAAGAGAGAGTGTGTATTAG | 78 | 1416 |
| 1073099 | N/A | N/A | 11210 | 11229 | TCTTTCTCTCCCTGGCAAGC | 73 | 1417 |
| 1073103 | N/A | N/A | 11283 | 11302 | TGGAAATGGAAAGCCCTCCC | 78 | 1418 |
| 1073107 | N/A | N/A | 11391 | 11410 | GAGTGGTAAGCTGCTGGAGT | 42 | 1419 |
| 1073111 | N/A | N/A | 11474 | 11493 | TGATAGTAACCACAGCTGCC | 92 | 1420 |
| 1073115 | N/A | N/A | 11518 | 11537 | GTGTAACCTTGGGAAGTCCC | 77 | 1421 |

TABLE 20

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1072812 | 1713 | 1732 | 12002 | 12021 | CAGTTTCCATAACAACAGGA | 58 | 1422 |
| 1072816 | 1722 | 1741 | 12011 | 12030 | CTCTGGCAACAGTTTCCATA | 69 | 1423 |
| 1072820 | 1749 | 1768 | 12038 | 12057 | TCCCAGATACTCCGAGAGAA | 73 | 1424 |
| 1072824 | 1758 | 1777 | 12047 | 12066 | AGGCACAGTTCCCAGATACT | 36 | 1425 |
| 1072828 | 1784 | 1803 | 12073 | 12092 | TCCTCCAGCAGCCTGAGGAA | 71 | 1426 |
| 1072832 | 1788 | 1807 | 12077 | 12096 | GTTTTCCTCCAGCAGCCTGA | 64 | 1427 |
| 1072836 | 2168 | 2187 | 12457 | 12476 | AAGCTCCCACCTGCCCACAG | 73 | 1428 |
| 1072840 | 2175 | 2194 | 12464 | 12483 | GAGAATCAAGCTCCCACCTG | 74 | 1429 |
| 1072844 | 3037 | 3056 | 13326 | 13345 | TTCCTCAGCGACTAAAGGCA | 61 | 1430 |
| 1072848 | 3042 | 3061 | 13331 | 13350 | TATTTTTCCTCAGCGACTAA | 69 | 1431 |
| 1072852 | 3063 | 3082 | 13352 | 13371 | GAAGGGCGCAGCATTTGTCT | 57 | 1432 |
| 1072856 | N/A | N/A | 8772 | 8791 | TGAGATATCTTGTGACCTTG | 43 | 1433 |
| 1072860 | N/A | N/A | 8776 | 8795 | CTTTTGAGATATCTTGTGAC | 62 | 1434 |
| 1072864 | N/A | N/A | 8783 | 8802 | TGTGAGGCTTTTGAGATATC | 43 | 1435 |
| 1072868 | N/A | N/A | 8788 | 8807 | CGTATTGTGAGGCTTTTGAG | 20 | 1436 |
| 1072872 | N/A | N/A | 7984 | 8003 | GGGTGACCCAAGTCCTTGGC | 14 | 1437 |
| 1072876 | N/A | N/A | 7992 | 8011 | AGTTTGGAGGGTGACCCAAG | 61 | 1438 |
| 1072880 | N/A | N/A | 11293 | 11312 | TTTACCAAGCTGGAAATGGA | 83 | 1439 |
| 1072884 | N/A | N/A | 11298 | 11317 | TTCCTTTTACCAAGCTGGAA | 77 | 1440 |
| 1072888 | N/A | N/A | 11310 | 11329 | TCCCCTGGTAGTTTCCTTTT | 85 | 1441 |
| 1072892 | N/A | N/A | 4055 | 4074 | CAGGGAGGTTCGGCCCCTCC | 83 | 1442 |
| 1072896 | N/A | N/A | 4174 | 4193 | CTCCTGGCAGAAGGCATGCG | 75 | 1443 |
| 1072900 | N/A | N/A | 4231 | 4250 | GGCCCCGCTGCTCCTGCACT | 105 | 1444 |

TABLE 20-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072904 | N/A | N/A | 4289 | 4308 | CAGAATAGGTGAGCTCGCTG | 83 | 1445 |
| 1072908 | N/A | N/A | 4307 | 4326 | TTTATATGGACACAGGCTCA | 83 | 1446 |
| 1072912 | N/A | N/A | 4482 | 4501 | TATGACCACCGCTTCACAGC | 95 | 1447 |
| 1072916 | N/A | N/A | 4558 | 4577 | CTGTCAGCTCAGTGAAGCGC | 86 | 1448 |
| 1072920 | N/A | N/A | 4628 | 4647 | CACTCACTGTTGCACACACA | 89 | 1449 |
| 1072924 | N/A | N/A | 4651 | 4670 | ACACAGGCGCATCCACAAGC | 98 | 1450 |
| 1072928 | N/A | N/A | 4739 | 4758 | GACTTGTCTGGAGGATGAGC | 73 | 1451 |
| 1072932 | N/A | N/A | 4785 | 4804 | CAGTAGAGCAGCAGGAGGAT | 82 | 1452 |
| 1072936 | N/A | N/A | 4882 | 4901 | GGACACATTCCTGGGTCCAG | 100 | 1453 |
| 1072940 | N/A | N/A | 5142 | 5161 | GGTGAGGAGTAGAGGGCCAC | 88 | 1454 |
| 1072944 | N/A | N/A | 5307 | 5326 | TCTCTCAGTTGCAATCTCTG | 84 | 1455 |
| 1072948 | N/A | N/A | 5453 | 5472 | GAGTTCGAATGCTCTCTTGT | 75 | 1456 |
| 1072952 | N/A | N/A | 5730 | 5749 | CCCACAGGCAGGGCTACCTT | 89 | 1457 |
| 1072956 | N/A | N/A | 5891 | 5910 | TACTTTTGAAAGCAATAGTG | 77 | 1458 |
| 1072960 | N/A | N/A | 5953 | 5972 | CTTAGAACAGAACAGTATCA | 101 | 1459 |
| 1072964 | N/A | N/A | 6028 | 6047 | TCTGGACTTCGGCTCTCTCA | 55 | 1460 |
| 1072968 | N/A | N/A | 6140 | 6159 | AAACAGACTGGCAGAGGCAT | 59 | 1461 |
| 1072972 | N/A | N/A | 6260 | 6279 | GAGCTGTGGTGTTCTCTACG | 58 | 1462 |
| 1072976 | N/A | N/A | 6380 | 6399 | TGTCCTCCACTAGGAATGGC | 76 | 1463 |
| 1072980 | N/A | N/A | 6459 | 6478 | TCACACTCCTCAGCTAGGTG | 32 | 1464 |
| 1072984 | N/A | N/A | 6563 | 6582 | GGCCTCACCCTGGGTTCTAA | 76 | 1465 |
| 1072988 | N/A | N/A | 6905 | 6924 | TTAGGCGAGCGGAGGCCTGG | 95 | 1466 |
| 1072992 | N/A | N/A | 6945 | 6964 | CACACTGACAGCTGCATCTG | 90 | 1467 |
| 1072996 | N/A | N/A | 7003 | 7022 | GCACAACACCTGGTCAGCAA | 73 | 1468 |
| 1073000 | N/A | N/A | 7085 | 7104 | GTTGGCCCTGGCTGGGACTT | 63 | 1469 |
| 1073004 | N/A | N/A | 7126 | 7145 | GAAATCAGGGAGGTGAGCAG | 63 | 1470 |
| 1073008 | N/A | N/A | 7475 | 7494 | GGTTTCGAGGCCCGGCCCCC | 73 | 1471 |
| 1073012 | N/A | N/A | 7518 | 7537 | ATGGAGCCGGCCGGTCCCGC | 92 | 1472 |
| 1073016 | N/A | N/A | 7762 | 7781 | TGTGATGAGGGCTCACCGGT | 65 | 1473 |
| 1073020 | N/A | N/A | 7797 | 7816 | CTACCGTGAGGCAGCAGGGA | 86 | 1474 |
| 1073024 | N/A | N/A | 7876 | 7895 | TGTGCTGGGCATTGAGGTGG | 64 | 1475 |
| 1073028 | N/A | N/A | 7967 | 7986 | GGCCTTGAGGCCTAATCAAT | 78 | 1476 |
| 1073032 | N/A | N/A | 8045 | 8064 | TGGGTGAGGTGAGGAGTCCA | 73 | 1477 |
| 1073036 | N/A | N/A | 8057 | 8076 | AGGCAGAAGAGATGGGTGAG | 67 | 1478 |
| 1073040 | N/A | N/A | 9355 | 9374 | GCCCCGCCCGAGAGAGAAAA | 92 | 1479 |
| 1073044 | N/A | N/A | 9407 | 9426 | ATCATTTCAGGGCCAATGCA | 66 | 1480 |

TABLE 20-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1073048 | N/A | N/A | 9423 | 9442 | TGTTCCTTAGCTAAGAATCA | 58 | 1481 |
| 1073052 | N/A | N/A | 9442 | 9461 | TCCAGAAGAAGAGGAATTTT | 94 | 1482 |
| 1073056 | N/A | N/A | 9488 | 9507 | AATTAAGTCCTGAGACATGC | 51 | 1483 |
| 1073060 | N/A | N/A | 9517 | 9536 | AGTCAGCCTGGTTAGCCTTT | 36 | 1484 |
| 1073064 | N/A | N/A | 9560 | 9579 | AGTGACCTGTGACTATCTAG | 35 | 1485 |
| 1073068 | N/A | N/A | 9889 | 9908 | TCTGCCGAAGGAAGGAAGGA | 77 | 1486 |
| 1073072 | N/A | N/A | 10129 | 10148 | TCCGTCGAAAGCAGGCAAGC | 83 | 1487 |
| 1073076 | N/A | N/A | 10555 | 10574 | GGTATTGAAATCAGGAGACC | 59 | 1488 |
| 1073080 | N/A | N/A | 10662 | 10681 | CAATAGTGCTGCTGCCAGAG | 54 | 1489 |
| 1073084 | N/A | N/A | 10727 | 10746 | GAACCTATGCAACCGAGCAG | 56 | 1490 |
| 1073088 | N/A | N/A | 11008 | 11027 | TATGTGCCAGCCCCAGGCTT | 89 | 1491 |
| 1073092 | N/A | N/A | 11128 | 11147 | TGGTACCAAGGCTCCCCTTA | 74 | 1492 |
| 1073096 | N/A | N/A | 11187 | 11206 | GCCCCCGAGTTTGAGGGTGA | 90 | 1493 |
| 1073100 | N/A | N/A | 11240 | 11259 | GTTGGAAGTGAAAGCTACTA | 58 | 1494 |
| 1073104 | N/A | N/A | 11365 | 11384 | AGCTCCCACTGTGGTTGGAG | 87 | 1495 |
| 1073108 | N/A | N/A | 11399 | 11418 | TGCCTGGCGAGTGGTAAGCT | 91 | 1496 |
| 1073112 | N/A | N/A | 11476 | 11495 | CTTGATAGTAACCACAGCTG | 63 | 1497 |
| 1073116 | N/A | N/A | 11561 | 11580 | AGTTAGGAGTTCACACAGAC | 72 | 1498 |

TABLE 21

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTCCTCAGCG | 8 | 517 |
| 1072813 | 1717 | 1736 | 12006 | 12025 | GCAACAGTTTCCATAACAAC | 32 | 1499 |
| 1072817 | 1725 | 1744 | 12014 | 12033 | CATCTCTGGCAACAGTTTCC | 62 | 1500 |
| 1072821 | 1751 | 1770 | 12040 | 12059 | GTTCCCAGATACTCCGAGAG | 53 | 1501 |
| 1072825 | 1759 | 1778 | 12048 | 12067 | AAGGCACAGTTCCCAGATAC | 51 | 1502 |
| 1072829 | 1785 | 1804 | 12074 | 12093 | TTCCTCCAGCAGCCTGAGGA | 89 | 1503 |
| 1072833 | 1789 | 1808 | 12078 | 12097 | AGTTTTCCTCCAGCAGCCTG | 46 | 1504 |
| 1072837 | 2171 | 2190 | 12460 | 12479 | ATCAAGCTCCCACCTGCCCA | 64 | 1505 |
| 1072841 | 2176 | 2195 | 12465 | 12484 | TGAGAATCAAGCTCCCACCT | 90 | 1506 |
| 1072845 | 3038 | 3057 | 13327 | 13346 | TTTCCTCAGCGACTAAAGGC | 52 | 1507 |
| 1072849 | 3057 | 3076 | 13346 | 13365 | CGCAGCATTTGTCTTTATTT | 26 | 1508 |

TABLE 21-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072853 | 3064 | 3083 | 13353 | 13372 | GGAAGGGCGCAGCATTTGTC | 43 | 1509 |
| 1072857 | N/A | N/A | 8773 | 8792 | TTGAGATATCTTGTGACCTT | 32 | 1510 |
| 1072861 | N/A | N/A | 8779 | 8798 | AGGCTTTTGAGATATCTTGT | 35 | 1511 |
| 1072865 | N/A | N/A | 8784 | 8803 | TTGTGAGGCTTTTGAGATAT | 47 | 1512 |
| 1072869 | N/A | N/A | 7977 | 7996 | CCAAGTCCTTGGCCTTGAGG | 93 | 1513 |
| 1072873 | N/A | N/A | 7988 | 8007 | TGGAGGGTGACCCAAGTCCT | 107 | 1514 |
| 1072877 | N/A | N/A | 7994 | 8013 | TTAGTTTGGAGGGTGACCCA | 68 | 1515 |
| 1072881 | N/A | N/A | 11295 | 11314 | CTTTTACCAAGCTGGAAATG | 103 | 1516 |
| 1072885 | N/A | N/A | 11299 | 11318 | TTTCCTTTTACCAAGCTGGA | 80 | 1517 |
| 1072889 | N/A | N/A | 4027 | 4046 | TCTCGGGCACTCCTTCTTGG | 96 | 1518 |
| 1072893 | N/A | N/A | 4084 | 4103 | CCCATCAAGAGGTAGGGAGG | 66 | 1519 |
| 1072897 | N/A | N/A | 4183 | 4202 | GACCCTGGACTCCTGGCAGA | 83 | 1520 |
| 1072901 | N/A | N/A | 4253 | 4272 | CCAGCCATGAATGAAACACA | 82 | 1521 |
| 1072905 | N/A | N/A | 4293 | 4312 | GGCTCAGAATAGGTGAGCTC | 67 | 1522 |
| 1072909 | N/A | N/A | 4435 | 4454 | GTCACAAGCTGGTGGCAGGC | 69 | 1523 |
| 1072913 | N/A | N/A | 4487 | 4506 | TTTATTATGACCACCGCTTC | 92 | 1524 |
| 1072917 | N/A | N/A | 4563 | 4582 | ATGTCCTGTCAGCTCAGTGA | 50 | 1525 |
| 1072921 | N/A | N/A | 4632 | 4651 | CATACACTCACTGTTGCACA | 83 | 1526 |
| 1072925 | N/A | N/A | 4669 | 4688 | GTGCACCTGCTTCTGCTCAC | 111 | 1527 |
| 1072929 | N/A | N/A | 4741 | 4760 | AGGACTTGTCTGGAGGATGA | 47 | 1528 |
| 1072933 | N/A | N/A | 4822 | 4841 | TGAGGCAGCTGTCACAGAGA | 102 | 1529 |
| 1072937 | N/A | N/A | 4904 | 4923 | CATCCTGGAGCCTGGAGTGG | 87 | 1530 |
| 1072941 | N/A | N/A | 5295 | 5314 | AATCTCTGTGTTGAGCTTTC | 56 | 1531 |
| 1072945 | N/A | N/A | 5308 | 5327 | CTCTCTCAGTTGCAATCTCT | 75 | 1532 |
| 1072949 | N/A | N/A | 5460 | 5479 | CGGCCAGGAGTTCGAATGCT | 81 | 1533 |
| 1072953 | N/A | N/A | 5733 | 5752 | TGGCCCACAGGCAGGGCTAC | 83 | 1534 |
| 1072957 | N/A | N/A | 5895 | 5914 | TGGGTACTTTTGAAAGCAAT | 75 | 1535 |
| 1072961 | N/A | N/A | 5965 | 5984 | AAAAGCACAGGGCTTAGAAC | 76 | 1536 |
| 1072965 | N/A | N/A | 6031 | 6050 | CTCTCTGGACTTCGGCTCTC | 88 | 1537 |
| 1072969 | N/A | N/A | 6167 | 6186 | GGCATATGGTAGAGGCTCAG | 56 | 1538 |
| 1072973 | N/A | N/A | 6270 | 6289 | TATAAGCTCTGAGCTGTGGT | 37 | 1539 |
| 1072977 | N/A | N/A | 6443 | 6462 | GGTGCCCTGGCTAGGCTAGC | 77 | 1540 |
| 1072981 | N/A | N/A | 6460 | 6479 | CTCACACTCCTCAGCTAGGT | 77 | 1541 |
| 1072985 | N/A | N/A | 6897 | 6916 | GCGGAGGCCTGGGTGTTTTG | 75 | 1542 |
| 1072989 | N/A | N/A | 6908 | 6927 | GTCTTAGGCGAGCGGAGGCC | 90 | 1543 |
| 1072993 | N/A | N/A | 6972 | 6991 | AACAGTGCCACAGAATCCAG | 91 | 1544 |

TABLE 21-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072997 | N/A | N/A | 7051 | 7070 | GACCCATGGATGCGGGCAGG | 68 | 1545 |
| 1073001 | N/A | N/A | 7086 | 7105 | CGTTGGCCCTGGCTGGGACT | 71 | 1546 |
| 1073005 | N/A | N/A | 7201 | 7220 | TCTGTCAGGTCTGCAAACTA | 83 | 1547 |
| 1073009 | N/A | N/A | 7479 | 7498 | GGGAGGTTTCGAGGCCCGGC | 41 | 1548 |
| 1073013 | N/A | N/A | 7520 | 7539 | GGATGGAGCCGGCCGGTCCC | 81 | 1549 |
| 1073017 | N/A | N/A | 7764 | 7783 | GCTGTGATGAGGGCTCACCG | 68 | 1550 |
| 1073021 | N/A | N/A | 7818 | 7837 | CTGAAGGGAGCAAGATGAGC | 82 | 1551 |
| 1073025 | N/A | N/A | 7878 | 7897 | ACTGTGCTGGGCATTGAGGT | 77 | 1552 |
| 1073029 | N/A | N/A | 8005 | 8024 | GAGTATGCCTCTTAGTTTGG | 63 | 1553 |
| 1073033 | N/A | N/A | 8046 | 8065 | ATGGGTGAGGTGAGGAGTCC | 36 | 1554 |
| 1073037 | N/A | N/A | 8078 | 8097 | GTGGTGAAGAAAGTTCCAAG | 88 | 1555 |
| 1073041 | N/A | N/A | 9356 | 9375 | CGCCCCGCCCGAGAGAGAAA | 64 | 1556 |
| 1073045 | N/A | N/A | 9409 | 9428 | GAATCATTTCAGGGCCAATG | 27 | 1557 |
| 1073049 | N/A | N/A | 9425 | 9444 | TTTGTTCCTTAGCTAAGAAT | 62 | 1558 |
| 1073053 | N/A | N/A | 9444 | 9463 | AGTCCAGAAGAAGAGGAATT | 68 | 1559 |
| 1073057 | N/A | N/A | 9497 | 9516 | CTGATGCTGAATTAAGTCCT | 50 | 1560 |
| 1073061 | N/A | N/A | 9519 | 9538 | CTAGTCAGCCTGGTTAGCCT | 57 | 1561 |
| 1073065 | N/A | N/A | 9577 | 9596 | CCATTTATCTGTGCTTTAGT | 39 | 1562 |
| 1073069 | N/A | N/A | 9892 | 9911 | CGCTCTGCCGAAGGAAGGAA | 61 | 1563 |
| 1073073 | N/A | N/A | 10548 | 10567 | AAATCAGGAGACCAGGAGGG | 59 | 1564 |
| 1073077 | N/A | N/A | 10561 | 10580 | CAGCACGGTATTGAAATCAG | 42 | 1565 |
| 1073081 | N/A | N/A | 10692 | 10711 | TTCCAAACGGGCTGGAGAGC | 84 | 1566 |
| 1073085 | N/A | N/A | 10804 | 10823 | ATGGACTTTCAGGGCATGAG | 64 | 1567 |
| 1073089 | N/A | N/A | 11097 | 11116 | GGAGGGACTGAGGAAACGGA | 68 | 1568 |
| 1073093 | N/A | N/A | 11157 | 11176 | GTGTGTATTAGGATCCCATC | 24 | 1569 |
| 1073097 | N/A | N/A | 11193 | 11212 | AGCAAGGCCCCCGAGTTTGA | 81 | 1570 |
| 1073101 | N/A | N/A | 11246 | 11265 | GCTAGAGTTGGAAGTGAAAG | 67 | 1571 |
| 1073105 | N/A | N/A | 11368 | 11387 | ATGAGCTCCCACTGTGGTTG | 72 | 1572 |
| 1073109 | N/A | N/A | 11427 | 11446 | GATAACACTGGGAAAGCATT | 91 | 1573 |
| 1073113 | N/A | N/A | 11514 | 11533 | AACCTTGGGAAGTCCCCGAC | 85 | 1574 |
| 1073117 | N/A | N/A | 11563 | 11582 | ACAGTTAGGAGTTCACACAG | 75 | 1575 |

TABLE 22

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 5 | 517 |
| 1103152 | 41 | 60 | 3489 | 3508 | CTGGCTCTGCTCGCTCCTGG | 91 | 1576 |
| 1103168 | 272 | 291 | 3720 | 3739 | CTCCATCATCTCTGCCCGCT | 106 | 1577 |
| 1103184 | 565 | 584 | 4950 | 4969 | CTATAGGCAGCCAGGTTGTT | 69* | 1578 |
| 1103200 | 760 | 779 | 5646 | 5665 | ATCTCTTTCAGGGCTGCGGT | 65 | 1579 |
| 1103216 | 1062 | 1081 | 7634 | 7653 | TGAGGCTCTGCCCCTCTTCC | 111 | 1580 |
| 1103232 | 1335 | 1354 | 11624 | 11643 | CCTTGTGCTCCTGCTTGGAC | 88 | 1581 |
| 1103248 | 1527 | 1546 | 11816 | 11835 | AGGCCTGATACTGACGGAGC | 79 | 1582 |
| 1103264 | 1669 | 1688 | 11958 | 11977 | GTAGGTGCCCCCCGCCCTCC | 90 | 1583 |
| 1103280 | 1733 | 1752 | 12022 | 12041 | AGAACCTCCATCTCTGGCAA | 62 | 1584 |
| 1103296 | 1860 | 1879 | 12149 | 12168 | CCAAAAGACAAAACAAGCCT | 75 | 1585 |
| 1103312 | 1886 | 1905 | 12175 | 12194 | CATAGGGATATCCCACCTCA | 111 | 1586 |
| 1103328 | 2094 | 2113 | 12383 | 12402 | GTCATCGCTCAGGAGGTCCT | 69 | 1587 |
| 1103344 | 2231 | 2250 | 12520 | 12539 | CTATCCCTCCCAGCACCTCA | 109 | 1588 |
| 1103360 | 2427 | 2446 | 12716 | 12735 | AGGATGAGTCACTTCCTTAA | 73 | 1589 |
| 1103376 | 2484 | 2503 | 12773 | 12792 | GTCATGCCCTGCCCCCATGG | 90 | 1590 |
| 1103392 | 2512 | 2531 | 12801 | 12820 | AGGAAGAGGCCTTTAGAAAT | 68 | 1591 |
| 1103408 | 2672 | 2691 | 12961 | 12980 | GTGTGTGAGTAAGAAGGGAC | 55 | 1592 |
| 1103424 | 2724 | 2743 | 13013 | 13032 | TCAGTTTTACAATTGTAAAA | 83 | 1593 |
| 1103440 | 2899 | 2918 | 13188 | 13207 | GGAGAACCCTGAAGTGGGCC | 76 | 1594 |
| 1103472 | N/A | N/A | 8787 | 8806 | GTATTGTGAGGCTTTTGAGA | 43 | 1595 |
| 1103488 | N/A | N/A | 8899 | 8918 | GAGGCTCACTCCCTGTCAAG | 60 | 1596 |
| 1103504 | N/A | N/A | 9045 | 9064 | AACAAGCTCTGCCAGTTTAA | 66 | 1597 |
| 1103520 | N/A | N/A | 9234 | 9253 | TGAGTCAGCACTGAGCTGAG | 95 | 1598 |
| 1103536 | N/A | N/A | 9270 | 9289 | CAAGAGCTGCGGTCCTGAGG | 59 | 1599 |
| 1103552 | N/A | N/A | 9310 | 9329 | TTTAACATTAAGAGCAGGGA | 63 | 1600 |
| 1103568 | N/A | N/A | 8532 | 8551 | CTGGTATGATAGGCTCTGGC | 86 | 1601 |
| 1103584 | N/A | N/A | 8650 | 8669 | CAGACAGGGCAGATGTCAAG | 92 | 1602 |
| 1103600 | N/A | N/A | 3999 | 4018 | CCCCTTCTGCTCACAAGGCC | 121 | 1603 |
| 1103616 | N/A | N/A | 4160 | 4179 | CATGCGGGCATCAGATCCCC | 89 | 1604 |
| 1103632 | N/A | N/A | 4275 | 4294 | TCGCTGCCCACAGTCACAAA | 104 | 1605 |
| 1103648 | N/A | N/A | 4407 | 4426 | GTGCTTTGCGCCCAGACCTG | 105 | 1606 |
| 1103664 | N/A | N/A | 4496 | 4515 | GAAATGAATTTTATTATGAC | 106 | 1607 |
| 1103680 | N/A | N/A | 4640 | 4659 | TCCACAAGCATACACTCACT | 81 | 1608 |
| 1103696 | N/A | N/A | 4837 | 4856 | TGCCTCAGTCTCCCTTGAGG | 107 | 1609 |
| 1103712 | N/A | N/A | 5100 | 5119 | CCATTCCTCAGCCTTGCCTT | 98 | 1610 |

TABLE 22-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103728 | N/A | N/A | 5346 | 5365 | GTCTCTCTCAGTCTCAGCTT | 78 | 1611 |
| 1103744 | N/A | N/A | 5413 | 5432 | GTCTTTCTGTTTGTCTTTCA | 57 | 1612 |
| 1103760 | N/A | N/A | 5487 | 5506 | CCATTGTGTCCTCTTCTGCC | 102 | 1613 |
| 1103776 | N/A | N/A | 5776 | 5795 | TTCTCTTGTACAGAGCAAGA | 79 | 1614 |
| 1103792 | N/A | N/A | 5860 | 5879 | CTGGGCAAGCCATCTCACTT | 86 | 1615 |
| 1103808 | N/A | N/A | 5941 | 5960 | CAGTATCAGCTACTACTAAT | 80 | 1616 |
| 1103824 | N/A | N/A | 5978 | 5997 | AAGGTAATCCATGAAAAGCA | 84 | 1617 |
| 1103840 | N/A | N/A | 6024 | 6043 | GACTTCGGCTCTCTCATCTG | 82 | 1618 |
| 1103856 | N/A | N/A | 6204 | 6223 | CCAGGTCAGACACCTCTCTG | 81 | 1619 |
| 1103872 | N/A | N/A | 6267 | 6286 | AAGCTCTGAGCTGTGGTGTT | 33 | 1620 |
| 1103888 | N/A | N/A | 6315 | 6334 | CCCAAATGCCCCCTCTACAG | 93 | 1621 |
| 1103904 | N/A | N/A | 6414 | 6433 | CCCTGCCTCTCTGTGCTTTT | 92 | 1622 |
| 1103920 | N/A | N/A | 6517 | 6536 | AGGTCCTCCCAGCCCCATCG | 108 | 1623 |
| 1103936 | N/A | N/A | 6947 | 6966 | TCCACACTGACAGCTGCATC | 92 | 1624 |
| 1103952 | N/A | N/A | 7030 | 7049 | TAGCGGGCTGCCAGACCTCA | 102 | 1625 |
| 1103968 | N/A | N/A | 7326 | 7345 | CCCTGGCCGCGCTCACCGTG | 96 | 1626 |
| 1103984 | N/A | N/A | 7421 | 7440 | TTCAGGCCCCGCCCTCGACC | 81 | 1627 |
| 1104000 | N/A | N/A | 7814 | 7833 | AGGGAGCAAGATGAGCTCTA | 120 | 1628 |
| 1104016 | N/A | N/A | 7940 | 7959 | GAATCCATCCATCCATTCAG | 86 | 1629 |
| 1104032 | N/A | N/A | 8038 | 8057 | GGTGAGGAGTCCAATCTTGG | 76 | 1630 |
| 1104048 | N/A | N/A | 8080 | 8099 | AAGTGGTGAAGAAAGTTCCA | 108 | 1631 |
| 1104064 | N/A | N/A | 8251 | 8270 | CATCATGACAACTTGAACGC | 98 | 1632 |
| 1104080 | N/A | N/A | 9364 | 9383 | CCTCCCCCCGCCCCGCCCGA | 111 | 1633 |
| 1104096 | N/A | N/A | 9414 | 9433 | GCTAAGAATCATTTCAGGGC | 40 | 1634 |
| 1104112 | N/A | N/A | 9455 | 9474 | CTAAATATTCTAGTCCAGAA | 97 | 1635 |
| 1104128 | N/A | N/A | 9509 | 9528 | TGGTTAGCCTTTCTGATGCT | 84 | 1636 |
| 1104144 | N/A | N/A | 9535 | 9554 | GGCAGTATTACCTCTACTAG | 28 | 1637 |
| 1104160 | N/A | N/A | 9559 | 9578 | GTGACCTGTGACTATCTAGG | 47 | 1638 |
| 1104176 | N/A | N/A | 9579 | 9598 | TGCCATTTATCTGTGCTTTA | 50 | 1639 |
| 1104192 | N/A | N/A | 9665 | 9684 | TAAAGGCTGTTAAACATGTG | 51 | 1640 |
| 1104208 | N/A | N/A | 9785 | 9804 | ACCAGCCACATGACTCTGGG | 83 | 1641 |
| 1104224 | N/A | N/A | 10558 | 10577 | CACGGTATTGAAATCAGGAG | 47 | 1642 |
| 1104240 | N/A | N/A | 10654 | 10673 | CTGCTGCCAGAGTCCTGGCT | 88 | 1643 |
| 1104256 | N/A | N/A | 10753 | 10772 | CACCCCCCTCCCCATCATGA | 89 | 1644 |
| 1104272 | N/A | N/A | 10818 | 10837 | AGAGGAGGCCTCTCATGGAC | 96 | 1645 |
| 1104288 | N/A | N/A | 11083 | 11102 | AACGGAATTACATTCAGTTT | 81 | 1646 |

TABLE 22-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104304 | N/A | N/A | 11152 | 11171 | TATTAGGATCCCATCTAGTG | 103 | 1647 |
| 1104320 | N/A | N/A | 11230 | 11249 | AAAGCTACTAACTTTAATTC | 81 | 1648 |
| 1104336 | N/A | N/A | 11288 | 11307 | CAAGCTGGAAATGGAAAGCC | 83 | 1649 |
| 1104352 | N/A | N/A | 11390 | 11409 | AGTGGTAAGCTGCTGGAGTA | 85 | 1650 |
| 1104368 | N/A | N/A | 11499 | 11518 | CCGACTTCCCAGGTCTTACT | 78 | 1651 |

TABLE 23

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103150 | 20 | 39 | 3468 | 3487 | ATGCGAGGGCTTTATGAAGG | 82 | 1652 |
| 1103166 | 264 | 283 | 3712 | 3731 | TCTCTGCCCGCTCACTGGCC | 126 | 1653 |
| 1103182 | 549 | 568 | 4934 | 4953 | TGTTCTCGGCTTCCAGCCTC | 40* | 1654 |
| 1103198 | 758 | 777 | 5644 | 5663 | CTCTTTCAGGGCTGCGGTGA | 35 | 1655 |
| 1103214 | 1049 | 1068 | 7621 | 7640 | CTCTTCCTCCAGCCGCGCCA | 70 | 1656 |
| 1103230 | 1327 | 1346 | 11616 | 11635 | TCCTGCTTGGACTCCTTAAT | 69 | 1657 |
| 1103246 | 1501 | 1520 | 11790 | 11809 | CAGCAAGCTGACCTAGGGAC | 39 | 1658 |
| 1103262 | 1662 | 1681 | 11951 | 11970 | CCCCCCGCCCTCCTCCCCTT | 91 | 1659 |
| 1103278 | 1729 | 1748 | 12018 | 12037 | CCTCCATCTCTGGCAACAGT | 34 | 1660 |
| 1103294 | 1858 | 1877 | 12147 | 12166 | AAAAGACAAAACAAGCCTCT | 81 | 1661 |
| 1103310 | 1884 | 1903 | 12173 | 12192 | TAGGGATATCCCACCTCATA | 74 | 1662 |
| 1103326 | 2061 | 2080 | 12350 | 12369 | CAGGTGACTGCCCCAGGTGG | 73 | 1663 |
| 1103342 | 2228 | 2247 | 12517 | 12536 | TCCCTCCCAGCACCTCATCC | 80 | 1664 |
| 1103358 | 2424 | 2443 | 12713 | 12732 | ATGAGTCACTTCCTTAATTC | 58 | 1665 |
| 1103374 | 2467 | 2486 | 12756 | 12775 | TGGATACATCCCCTTTCTCT | 59 | 1666 |
| 1103390 | 2510 | 2529 | 12799 | 12818 | GAAGAGGCCTTTAGAAATGG | 76 | 1667 |
| 1103406 | 2668 | 2687 | 12957 | 12976 | GTGAGTAAGAAGGGACCGCA | 82 | 1668 |
| 1103422 | 2717 | 2736 | 13006 | 13025 | TACAATTGTAAAATAGGGCA | 90 | 1669 |
| 1103438 | 2849 | 2868 | 13138 | 13157 | ACCAGTCTGCTCACCAGTCT | 74 | 1670 |
| 1103470 | N/A | N/A | 8769 | 8788 | GATATCTTGTGACCTTGTGA | 34 | 1671 |
| 1103486 | N/A | N/A | 8897 | 8916 | GGCTCACTCCCTGTCAAGCT | 100 | 1672 |
| 1103502 | N/A | N/A | 9043 | 9062 | CAAGCTCTGCCAGTTTAATG | 30 | 1673 |
| 1103518 | N/A | N/A | 9224 | 9243 | CTGAGCTGAGCGATGGAGCC | 71 | 1674 |
| 1103534 | N/A | N/A | 9263 | 9282 | TGCGGTCCTGAGGGAAGAAT | 76 | 1675 |

TABLE 23-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103550 | N/A | N/A | 9308 | 9327 | TAACATTAAGAGCAGGGAAC | 77 | 1676 |
| 1103566 | N/A | N/A | 8500 | 8519 | AGTGTCACGAAGGCCCCCAG | 49 | 1677 |
| 1103582 | N/A | N/A | 8584 | 8603 | GGACCAGGGCCTAGCAGGAC | 69 | 1678 |
| 1103598 | N/A | N/A | 3993 | 4012 | CTGCTCACAAGGCCCCCCTT | 92 | 1679 |
| 1103614 | N/A | N/A | 4049 | 4068 | GGTTCGGCCCCTCCCTGAGA | 69 | 1680 |
| 1103630 | N/A | N/A | 4250 | 4269 | GCCATGAATGAAACACAGGG | 66 | 1681 |
| 1103646 | N/A | N/A | 4391 | 4410 | CCTGCCTGCTCTTTCCCTCA | 76 | 1682 |
| 1103662 | N/A | N/A | 4490 | 4509 | AATTTTATTATGACCACCGC | 110 | 1683 |
| 1103678 | N/A | N/A | 4635 | 4654 | AAGCATACACTCACTGTTGC | 78 | 1684 |
| 1103694 | N/A | N/A | 4817 | 4836 | CAGCTGTCACAGAGACCACC | 100 | 1685 |
| 1103710 | N/A | N/A | 5097 | 5116 | TTCCTCAGCCTTGCCTTACC | 78 | 1686 |
| 1103726 | N/A | N/A | 5305 | 5324 | TCTCAGTTGCAATCTCTGTG | 87 | 1687 |
| 1103742 | N/A | N/A | 5398 | 5417 | TTTCATTTCCTGTCTCTACC | 89 | 1688 |
| 1103758 | N/A | N/A | 5481 | 5500 | TGTCCTCTTCTGCCTGCCCC | 94 | 1689 |
| 1103774 | N/A | N/A | 5726 | 5745 | CAGGCAGGGCTACCTTGGAG | 87 | 1690 |
| 1103790 | N/A | N/A | 5849 | 5868 | ATCTCACTTCTCTGGTGAAA | 95 | 1691 |
| 1103806 | N/A | N/A | 5923 | 5942 | ATAATAGCAATAGTAGCAGT | 103 | 1692 |
| 1103822 | N/A | N/A | 5974 | 5993 | TAATCCATGAAAAGCACAGG | 84 | 1693 |
| 1103838 | N/A | N/A | 6020 | 6039 | TCGGCTCTCTCATCTGTCAA | 53 | 1694 |
| 1103854 | N/A | N/A | 6199 | 6218 | TCAGACACCTCTCTGTGTCC | 86 | 1695 |
| 1103870 | N/A | N/A | 6257 | 6276 | CTGTGGTGTTCTCTACGGGC | 78 | 1696 |
| 1103886 | N/A | N/A | 6313 | 6332 | CAAATGCCCCCTCTACAGTG | 105 | 1697 |
| 1103902 | N/A | N/A | 6408 | 6427 | CTCTCTGTGCTTTTCTGCCT | 71 | 1698 |
| 1103918 | N/A | N/A | 6501 | 6520 | ATCGGGCCCTCACCCTGCTC | 107 | 1699 |
| 1103934 | N/A | N/A | 6904 | 6923 | TAGGCGAGCGGAGGCCTGGG | 90 | 1700 |
| 1103950 | N/A | N/A | 7017 | 7036 | GACCTCAGCACCTAGCACAA | 82 | 1701 |
| 1103966 | N/A | N/A | 7314 | 7333 | TCACCGTGCCGCGCAGAGAC | 101 | 1702 |
| 1103982 | N/A | N/A | 7416 | 7435 | GCCCCGCCCTCGACCCAGGT | 88 | 1703 |
| 1103998 | N/A | N/A | 7805 | 7824 | GATGAGCTCTACCGTGAGGC | 71 | 1704 |
| 1104014 | N/A | N/A | 7922 | 7941 | AGTCATCAAACATCTAGTGA | 46 | 1705 |
| 1104030 | N/A | N/A | 8035 | 8054 | GAGGAGTCCAATCTTGGCTG | 67 | 1706 |
| 1104046 | N/A | N/A | 8075 | 8094 | GTGAAGAAAGTTCCAAGGAG | 93 | 1707 |
| 1104062 | N/A | N/A | 8228 | 8247 | TTTCCTTGCCAGGAAAGTCT | 81 | 1708 |
| 1104078 | N/A | N/A | 9359 | 9378 | CCCCGCCCCGCCCGAGAGAG | 36 | 1709 |
| 1104094 | N/A | N/A | 9412 | 9431 | TAAGAATCATTTCAGGGCCA | 71 | 1710 |
| 1104110 | N/A | N/A | 9452 | 9471 | AATATTCTAGTCCAGAAGAA | 103 | 1711 |

TABLE 23-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104126 | N/A | N/A | 9506 | 9525 | TTAGCCTTTCTGATGCTGAA | 58 | 1712 |
| 1104142 | N/A | N/A | 9530 | 9549 | TATTACCTCTACTAGTCAGC | 65 | 1713 |
| 1104158 | N/A | N/A | 9557 | 9576 | GACCTGTGACTATCTAGGAT | 18 | 1714 |
| 1104174 | N/A | N/A | 9576 | 9595 | CATTTATCTGTGCTTTAGTG | 37 | 1715 |
| 1104190 | N/A | N/A | 9660 | 9679 | GCTGTTAAACATGTGGCACA | 74 | 1716 |
| 1104206 | N/A | N/A | 9706 | 9725 | CCTACTTCTCTAGGTGGGAG | 65 | 1717 |
| 1104222 | N/A | N/A | 10556 | 10575 | CGGTATTGAAATCAGGAGAC | 47 | 1718 |
| 1104238 | N/A | N/A | 10610 | 10629 | TTTCAGCCCCTCTGCAAGCC | 68 | 1719 |
| 1104254 | N/A | N/A | 10747 | 10766 | CCTCCCCATCATGAGTATGA | 92 | 1720 |
| 1104270 | N/A | N/A | 10816 | 10835 | AGGAGGCCTCTCATGGACTT | 93 | 1721 |
| 1104286 | N/A | N/A | 11078 | 11097 | AATTACATTCAGTTTCCTTG | 88 | 1722 |
| 1104302 | N/A | N/A | 11150 | 11169 | TTAGGATCCCATCTAGTGGC | 60 | 1723 |
| 1104318 | N/A | N/A | 11225 | 11244 | TACTAACTTTAATTCTCTTT | 49 | 1724 |
| 1104334 | N/A | N/A | 11280 | 11299 | AAATGGAAAGCCCTCCCCAT | 98 | 1725 |
| 1104350 | N/A | N/A | 11388 | 11407 | TGGTAAGCTGCTGGAGTAAG | 55 | 1726 |
| 1104366 | N/A | N/A | 11494 | 11513 | TTCCCAGGTCTTACTTTTCT | 76 | 1727 |

TABLE 24

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103151 | 39 | 58 | 3487 | 3506 | GGCTCTGCTCGCTCCTGGGA | 108 | 1728 |
| 1103167 | 269 | 288 | 3717 | 3736 | CATCATCTCTGCCCGCTCAC | 93 | 1729 |
| 1103183 | 553 | 572 | 4938 | 4957 | AGGTTGTTCTCGGCTTCCAG | 55* | 1730 |
| 1103199 | 759 | 778 | 5645 | 5664 | TCTCTTTCAGGGCTGCGGTG | 54 | 1731 |
| 1103215 | 1050 | 1069 | 7622 | 7641 | CCTCTTCCTCCAGCCGCGCC | 64 | 1732 |
| 1103231 | 1334 | 1353 | 11623 | 11642 | CTTGTGCTCCTGCTTGGACT | 53 | 1733 |
| 1103247 | 1518 | 1537 | 11807 | 11826 | ACTGACGGAGCCTAGGGCAG | 61 | 1734 |
| 1103263 | 1667 | 1686 | 11956 | 11975 | AGGTGCCCCCGCCCTCCTC | 98 | 1735 |
| 1103279 | 1730 | 1749 | 12019 | 12038 | ACCTCCATCTCTGGCAACAG | 25 | 1736 |
| 1103295 | 1859 | 1878 | 12148 | 12167 | CAAAAGACAAAACAAGCCTC | 73 | 1737 |
| 1103311 | 1885 | 1904 | 12174 | 12193 | ATAGGGATATCCCACCTCAT | 75 | 1738 |
| 1103327 | 2086 | 2105 | 12375 | 12394 | TCAGGAGGTCCTTCTGGGAT | 67 | 1739 |

TABLE 24-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103343 | 2230 | 2249 | 12519 | 12538 | TATCCCTCCCAGCACCTCAT | 63 | 1740 |
| 1103359 | 2425 | 2444 | 12714 | 12733 | GATGAGTCACTTCCTTAATT | 35 | 1741 |
| 1103375 | 2483 | 2502 | 12772 | 12791 | TCATGCCCTGCCCCATGGA | 69 | 1742 |
| 1103391 | 2511 | 2530 | 12800 | 12819 | GGAAGAGGCCTTTAGAAATG | 74 | 1743 |
| 1103407 | 2670 | 2689 | 12959 | 12978 | GTGTGAGTAAGAAGGGACCG | 46 | 1744 |
| 1103423 | 2722 | 2741 | 13011 | 13030 | AGTTTTACAATTGTAAATA | 88 | 1745 |
| 1103439 | 2868 | 2887 | 13157 | 13176 | ATCTCTGGGCACAGATCCCA | 93 | 1746 |
| 1103471 | N/A | N/A | 8770 | 8789 | AGATATCTTGTGACCTTGTG | 35 | 1747 |
| 1103487 | N/A | N/A | 8898 | 8917 | AGGCTCACTCCCTGTCAAGC | 62 | 1748 |
| 1103503 | N/A | N/A | 9044 | 9063 | ACAAGCTCTGCCAGTTTAAT | 51 | 1749 |
| 1103519 | N/A | N/A | 9225 | 9244 | ACTGAGCTGAGCGATGGAGC | 65 | 1750 |
| 1103535 | N/A | N/A | 9266 | 9285 | AGCTGCGGTCCTGAGGGAAG | 59 | 1751 |
| 1103551 | N/A | N/A | 9309 | 9328 | TTAACATTAAGAGCAGGGAA | 68 | 1752 |
| 1103567 | N/A | N/A | 8530 | 8549 | GGTATGATAGGCTCTGGCTA | 21 | 1753 |
| 1103583 | N/A | N/A | 8649 | 8668 | AGACAGGGCAGATGTCAAGC | 90 | 1754 |
| 1103599 | N/A | N/A | 3994 | 4013 | TCTGCTCACAAGGCCCCCT | 56 | 1755 |
| 1103615 | N/A | N/A | 4053 | 4072 | GGGAGGTTCGGCCCCTCCCT | 94 | 1756 |
| 1103631 | N/A | N/A | 4251 | 4270 | AGCCATGAATGAAACACAGG | 115 | 1757 |
| 1103647 | N/A | N/A | 4401 | 4420 | TGCGCCCAGACCTGCCTGCT | 75 | 1758 |
| 1103663 | N/A | N/A | 4495 | 4514 | AAATGAATTTTATTATGACC | 80 | 1759 |
| 1103679 | N/A | N/A | 4636 | 4655 | CAAGCATACACTCACTGTTG | 69 | 1760 |
| 1103695 | N/A | N/A | 4820 | 4839 | AGGCAGCTGTCACAGAGACC | 95 | 1761 |
| 1103711 | N/A | N/A | 5099 | 5118 | CATTCCTCAGCCTTGCCTTA | 95 | 1762 |
| 1103727 | N/A | N/A | 5311 | 5330 | TCCCTCTCTCAGTTGCAATC | 79 | 1763 |
| 1103743 | N/A | N/A | 5412 | 5431 | TCTTTCTGTTTGTCTTTCAT | 71 | 1764 |
| 1103759 | N/A | N/A | 5482 | 5501 | GTGTCCTCTTCTGCCTGCCC | 59 | 1765 |
| 1103775 | N/A | N/A | 5775 | 5794 | TCTCTTGTACAGAGCAAGAA | 110 | 1766 |
| 1103791 | N/A | N/A | 5853 | 5872 | AGCCATCTCACTTCTCTGGT | 67 | 1767 |
| 1103807 | N/A | N/A | 5930 | 5949 | ACTACTAATAATAGCAATAG | 82 | 1768 |
| 1103823 | N/A | N/A | 5975 | 5994 | GTAATCCATGAAAAGCACAG | 97 | 1769 |
| 1103839 | N/A | N/A | 6022 | 6041 | CTTCGGCTCTCTCATCTGTC | 76 | 1770 |
| 1103855 | N/A | N/A | 6203 | 6222 | CAGGTCAGACACCTCTCTGT | 76 | 1771 |
| 1103871 | N/A | N/A | 6265 | 6284 | GCTCTGAGCTGTGGTGTTCT | 88 | 1772 |
| 1103887 | N/A | N/A | 6314 | 6333 | CCAAATGCCCCCTCTACAGT | 92 | 1773 |
| 1103903 | N/A | N/A | 6409 | 6428 | CCTCTCTGTGCTTTTCTGCC | 60 | 1774 |
| 1103919 | N/A | N/A | 6516 | 6535 | GGTCCTCCCAGCCCCATCGG | 79 | 1775 |

TABLE 24-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103935 | N/A | N/A | 6906 | 6925 | CTTAGGCGAGCGGAGGCCTG | 85 | 1776 |
| 1103951 | N/A | N/A | 7021 | 7040 | GCCAGACCTCAGCACCTAGC | 65 | 1777 |
| 1103967 | N/A | N/A | 7316 | 7335 | GCTCACCGTGCCGCGCAGAG | 76 | 1778 |
| 1103983 | N/A | N/A | 7420 | 7439 | TCAGGCCCCGCCCTCGACCC | 88 | 1779 |
| 1103999 | N/A | N/A | 7806 | 7825 | AGATGAGCTCTACCGTGAGG | 66 | 1780 |
| 1104015 | N/A | N/A | 7930 | 7949 | ATCCATTCAGTCATCAAACA | 90 | 1781 |
| 1104031 | N/A | N/A | 8037 | 8056 | GTGAGGAGTCCAATCTTGGC | 77 | 1782 |
| 1104047 | N/A | N/A | 8076 | 8095 | GGTGAAGAAAGTTCCAAGGA | 59 | 1783 |
| 1104063 | N/A | N/A | 8229 | 8248 | TTTTCCTTGCCAGGAAAGTC | 76 | 1784 |
| 1104079 | N/A | N/A | 9360 | 9379 | CCCCCGCCCCGCCCGAGAGA | 103 | 1785 |
| 1104095 | N/A | N/A | 9413 | 9432 | CTAAGAATCATTTCAGGGCC | 65 | 1786 |
| 1104111 | N/A | N/A | 9454 | 9473 | TAAATATTCTAGTCCAGAAG | 87 | 1787 |
| 1104127 | N/A | N/A | 9508 | 9527 | GGTTAGCCTTTCTGATGCTG | 30 | 1788 |
| 1104143 | N/A | N/A | 9531 | 9550 | GTATTACCTCTACTAGTCAG | 56 | 1789 |
| 1104159 | N/A | N/A | 9558 | 9577 | TGACCTGTGACTATCTAGGA | 29 | 1790 |
| 1104175 | N/A | N/A | 9578 | 9597 | GCCATTTATCTGTGCTTTAG | 10 | 1791 |
| 1104191 | N/A | N/A | 9664 | 9683 | AAAGGCTGTTAAACATGTGG | 39 | 1792 |
| 1104207 | N/A | N/A | 9707 | 9726 | GCCTACTTCTCTAGGTGGGA | 69 | 1793 |
| 1104223 | N/A | N/A | 10557 | 10576 | ACGGTATTGAAATCAGGAGA | 55 | 1794 |
| 1104239 | N/A | N/A | 10639 | 10658 | TGGCTGCTCTGTCTTCTGGC | 52 | 1795 |
| 1104255 | N/A | N/A | 10748 | 10767 | CCCTCCCCATCATGAGTATG | 79 | 1796 |
| 1104271 | N/A | N/A | 10817 | 10836 | GAGGAGGCCTCTCATGGACT | 95 | 1797 |
| 1104287 | N/A | N/A | 11082 | 11101 | ACGGAATTACATTCAGTTTC | 77 | 1798 |
| 1104303 | N/A | N/A | 11151 | 11170 | ATTAGGATCCCATCTAGTGG | 68 | 1799 |
| 1104319 | N/A | N/A | 11229 | 11248 | AAGCTACTAACTTTAATTCT | 92 | 1800 |
| 1104335 | N/A | N/A | 11281 | 11300 | GAAATGGAAAGCCCTCCCCA | 113 | 1801 |
| 1104351 | N/A | N/A | 11389 | 11408 | GTGGTAAGCTGCTGGAGTAA | 60 | 1802 |
| 1104367 | N/A | N/A | 11498 | 11517 | CGACTTCCCAGGTCTTACTT | 74 | 1803 |

TABLE 25

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTCCTCAGCG | 7 | 517 |
| 1103153 | 44 | 63 | 3492 | 3511 | GCTCTGGCTCTGCTCGCTCC | 83 | 1804 |

TABLE 25-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103169 | 354 | 373 | 3802 | 3821 | GGTTCAGCTCAGCAGCCAGC | 85 | 1805 |
| 1103185 | 566 | 585 | 4951 | 4970 | TCTATAGGCAGCCAGGTTGT | 73* | 1806 |
| 1103201 | 762 | 781 | 5648 | 5667 | GGATCTCTTTCAGGGCTGCG | 90 | 1807 |
| 1103217 | 1185 | 1204 | N/A | N/A | GAATGGTGATCCGGTTCTCC | 23 | 1808 |
| 1103233 | 1350 | 1369 | 11639 | 11658 | TGCCTCACATCACATCCTTG | 98 | 1809 |
| 1103249 | 1528 | 1547 | 11817 | 11836 | CAGGCCTGATACTGACGGAG | 103 | 1810 |
| 1103265 | 1670 | 1689 | 11959 | 11978 | AGTAGGTGCCCCCCGCCCTC | 74 | 1811 |
| 1103281 | 1750 | 1769 | 12039 | 12058 | TTCCCAGATACTCCGAGAGA | 65 | 1812 |
| 1103297 | 1861 | 1880 | 12150 | 12169 | ACCAAAAGACAAAACAAGCC | 113 | 1813 |
| 1103313 | 1887 | 1906 | 12176 | 12195 | GCATAGGGATATCCCACCTC | 95 | 1814 |
| 1103329 | 2097 | 2116 | 12386 | 12405 | TGAGTCATCGCTCAGGAGGT | 47 | 1815 |
| 1103345 | 2331 | 2350 | 12620 | 12639 | TCCTCCTCCATCTCTACCAG | 44 | 1816 |
| 1103361 | 2431 | 2450 | 12720 | 12739 | CAAGAGGATGAGTCACTTCC | 49 | 1817 |
| 1103377 | 2485 | 2504 | 12774 | 12793 | AGTCATGCCCTGCCCCCATG | 46 | 1818 |
| 1103393 | 2516 | 2535 | 12805 | 12824 | AGCAAGGAAGAGGCCTTTAG | 68 | 1819 |
| 1103409 | 2673 | 2692 | 12962 | 12981 | TGTGTGTGAGTAAGAAGGGA | 30 | 1820 |
| 1103425 | 2725 | 2744 | 13014 | 13033 | CTCAGTTTTACAATTGTAAA | 71 | 1821 |
| 1103441 | 2905 | 2924 | 13194 | 13213 | GGGAGAGGAGAACCCTGAAG | 98 | 1822 |
| 1103473 | N/A | N/A | 8813 | 8832 | CTGGTGAGCCTGTATTGGTA | 68 | 1823 |
| 1103489 | N/A | N/A | 8975 | 8994 | AAAATGACGCAGTCCAGGCC | 108 | 1824 |
| 1103505 | N/A | N/A | 9046 | 9065 | TAACAAGCTCTGCCAGTTTA | 92 | 1825 |
| 1103521 | N/A | N/A | 9238 | 9257 | GAACTGAGTCAGCACTGAGC | 124 | 1826 |
| 1103537 | N/A | N/A | 9279 | 9298 | TATTCACTGCAAGAGCTGCG | 111 | 1827 |
| 1103553 | N/A | N/A | 9313 | 9332 | ATATTTAACATTAAGAGCAG | 84 | 1828 |
| 1103569 | N/A | N/A | 8533 | 8552 | CCTGGTATGATAGGCTCTGG | 56 | 1829 |
| 1103585 | N/A | N/A | 8655 | 8674 | ATCTGCAGACAGGGCAGATG | 113 | 1830 |
| 1103601 | N/A | N/A | 4001 | 4020 | AGCCCCTTCTGCTCACAAGG | 74 | 1831 |
| 1103617 | N/A | N/A | 4172 | 4191 | CCTGGCAGAAGGCATGCGGG | 120 | 1832 |
| 1103633 | N/A | N/A | 4295 | 4314 | CAGGCTCAGAATAGGTGAGC | 80 | 1833 |
| 1103649 | N/A | N/A | 4410 | 4429 | CCTGTGCTTTGCGCCCAGAC | 92 | 1834 |
| 1103665 | N/A | N/A | 4505 | 4524 | CCACCTTTTGAAATGAATTT | 63 | 1835 |
| 1103681 | N/A | N/A | 4641 | 4660 | ATCCACAAGCATACACTCAC | 62 | 1836 |
| 1103697 | N/A | N/A | 4845 | 4864 | TGAATACCTGCCTCAGTCTC | 68 | 1837 |
| 1103713 | N/A | N/A | 5101 | 5120 | CCCATTCCTCAGCCTTGCCT | 95 | 1838 |
| 1103729 | N/A | N/A | 5351 | 5370 | TGAGTGTCTCTCTCAGTCTC | 132 | 1839 |
| 1103745 | N/A | N/A | 5420 | 5439 | CCTTAGTGTCTTTCTGTTTG | 69 | 1840 |

TABLE 25-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103761 | N/A | N/A | 5489 | 5508 | CGCCATTGTGTCCTCTTCTG | 86 | 1841 |
| 1103777 | N/A | N/A | 5778 | 5797 | CATTCTCTTGTACAGAGCAA | 105 | 1842 |
| 1103793 | N/A | N/A | 5861 | 5880 | CCTGGGCAAGCCATCTCACT | 119 | 1843 |
| 1103809 | N/A | N/A | 5943 | 5962 | AACAGTATCAGCTACTACTA | 80 | 1844 |
| 1103825 | N/A | N/A | 5979 | 5998 | TAAGGTAATCCATGAAAAGC | 101 | 1845 |
| 1103841 | N/A | N/A | 6108 | 6127 | CCCAAGTGAGATGTGCTAGA | 118 | 1846 |
| 1103857 | N/A | N/A | 6205 | 6224 | TCCAGGTCAGACACCTCTCT | 97 | 1847 |
| 1103873 | N/A | N/A | 6268 | 6287 | TAAGCTCTGAGCTGTGGTGT | 51 | 1848 |
| 1103889 | N/A | N/A | 6316 | 6335 | GCCCAAATGCCCCCTCTACA | 73 | 1849 |
| 1103905 | N/A | N/A | 6415 | 6434 | GCCCTGCCTCTCTGTGCTTT | 64 | 1850 |
| 1103921 | N/A | N/A | 6522 | 6541 | CAGGGAGGTCCTCCCAGCCC | 101 | 1851 |
| 1103937 | N/A | N/A | 6948 | 6967 | TTCCACACTGACAGCTGCAT | 76 | 1852 |
| 1103953 | N/A | N/A | 7077 | 7096 | TGGCTGGGACTTTTCCCAAC | 113 | 1853 |
| 1103969 | N/A | N/A | 7330 | 7349 | CCTGCCCTGGCCGCGCTCAC | 87 | 1854 |
| 1103985 | N/A | N/A | 7423 | 7442 | CGTTCAGGCCCCGCCCTCGA | 78 | 1855 |
| 1104001 | N/A | N/A | 7815 | 7834 | AAGGGAGCAAGATGAGCTCT | 77 | 1856 |
| 1104017 | N/A | N/A | 7956 | 7975 | CTAATCAATATTGGTTGAAT | 87 | 1857 |
| 1104033 | N/A | N/A | 8039 | 8058 | AGGTGAGGAGTCCAATCTTG | 82 | 1858 |
| 1104049 | N/A | N/A | 8082 | 8101 | GAAAGTGGTGAAGAAAGTTC | 109 | 1859 |
| 1104065 | N/A | N/A | 8252 | 8271 | CCATCATGACAACTTGAACG | 110 | 1860 |
| 1104081 | N/A | N/A | 9377 | 9396 | AATTTAGCTCCCCCCTCCCC | 83 | 1861 |
| 1104097 | N/A | N/A | 9417 | 9436 | TTAGCTAAGAATCATTTCAG | 125 | 1862 |
| 1104113 | N/A | N/A | 9456 | 9475 | CCTAAATATTCTAGTCCAGA | 47 | 1863 |
| 1104129 | N/A | N/A | 9511 | 9530 | CCTGGTTAGCCTTTCTGATG | 47 | 1864 |
| 1104145 | N/A | N/A | 9537 | 9556 | TTGGCAGTATTACCTCTACT | 19 | 1865 |
| 1104161 | N/A | N/A | 9561 | 9580 | TAGTGACCTGTGACTATCTA | 47 | 1866 |
| 1104177 | N/A | N/A | 9580 | 9599 | CTGCCATTTATCTGTGCTTT | 52 | 1867 |
| 1104193 | N/A | N/A | 9672 | 9691 | ACTAAAATAAAGGCTGTTAA | 67 | 1868 |
| 1104209 | N/A | N/A | 9786 | 9805 | AACCAGCCACATGACTCTGG | 91 | 1869 |
| 1104225 | N/A | N/A | 10559 | 10578 | GCACGGTATTGAAATCAGGA | 30 | 1870 |
| 1104241 | N/A | N/A | 10655 | 10674 | GCTGCTGCCAGAGTCCTGGC | 69 | 1871 |
| 1104257 | N/A | N/A | 10761 | 10780 | CCCCATCGCACCCCCTCCC | 103 | 1872 |
| 1104273 | N/A | N/A | 10843 | 10862 | CAGGCTGGTTTCTGCAGATG | 92 | 1873 |
| 1104289 | N/A | N/A | 11084 | 11103 | AAACGGAATTACATTCAGTT | 67 | 1874 |
| 1104305 | N/A | N/A | 11153 | 11172 | GTATTAGGATCCCATCTAGT | 58 | 1875 |
| 1104321 | N/A | N/A | 11231 | 11250 | GAAAGCTACTAACTTTAATT | 60 | 1876 |

TABLE 25-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104337 | N/A | N/A | 11308 | 11327 | CCCTGGTAGTTTCCTTTTAC | 55 | 1877 |
| 1104353 | N/A | N/A | 11392 | 11411 | CGAGTGGTAAGCTGCTGGAG | 69 | 1878 |
| 1104369 | N/A | N/A | 11512 | 11531 | CCTTGGGAAGTCCCCGACTT | 78 | 1879 |

TABLE 26

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103154 | 109 | 128 | 3557 | 3576 | ATCATCTCCCCTGAGGAGAC | 139 | 1880 |
| 1103170 | 376 | 395 | 3824 | 3843 | GTGGGCTCCTTGGCCCGCAG | 89 | 1881 |
| 1103186 | 576 | 595 | N/A | N/A | CTGCTTCCTGTCTATAGGCA | 30* | 1882 |
| 1103202 | 763 | 782 | 5649 | 5668 | CGGATCTCTTTCAGGGCTGC | 38 | 1883 |
| 1103218 | 1202 | 1221 | 8351 | 8370 | GGAGAAGGTCTGCACGGGAA | 43 | 1884 |
| 1103234 | 1355 | 1374 | 11644 | 11663 | GGTCCTGCCTCACATCACAT | 87 | 1885 |
| 1103250 | 1532 | 1551 | 11821 | 11840 | CTGGCAGGCCTGATACTGAC | 93 | 1886 |
| 1103266 | 1679 | 1698 | 11968 | 11987 | GGGCGATGTAGTAGGTGCCC | 100 | 1887 |
| 1103282 | 1762 | 1781 | 12051 | 12070 | TCAAAGGCACAGTTCCAGA | 89 | 1888 |
| 1103298 | 1862 | 1881 | 12151 | 12170 | AACCAAAAGACAAAACAAGC | 80 | 1889 |
| 1103314 | 1889 | 1908 | 12178 | 12197 | CAGCATAGGGATATCCCACC | 86 | 1890 |
| 1103330 | 2098 | 2117 | 12387 | 12406 | TTGAGTCATCGCTCAGGAGG | 49 | 1891 |
| 1103346 | 2332 | 2351 | 12621 | 12640 | CTCCTCCTCCATCTCTACCA | 81 | 1892 |
| 1103362 | 2436 | 2455 | 12725 | 12744 | ATCTTCAAGAGGATGAGTCA | 116 | 1893 |
| 1103378 | 2487 | 2506 | 12776 | 12795 | AAAGTCATGCCCTGCCCCCA | 74 | 1894 |
| 1103394 | 2526 | 2545 | 12815 | 12834 | GGTATGACACAGCAAGGAAG | 59 | 1895 |
| 1103410 | 2674 | 2693 | 12963 | 12982 | TTGTGTGTGAGTAAGAAGGG | 52 | 1896 |
| 1103426 | 2730 | 2749 | 13019 | 13038 | CGTGCCTCAGTTTTACAATT | 73 | 1897 |
| 1103442 | 2963 | 2982 | 13252 | 13271 | TGGAGGGAAAGGACACCAAG | 79 | 1898 |
| 1103458 | N/A | N/A | 8740 | 8759 | TCTTTGGTGCTTTTGCCCCC | 50 | 1899 |
| 1103474 | N/A | N/A | 8814 | 8833 | TCTGGTGAGCCTGTATTGGT | 66 | 1900 |
| 1103490 | N/A | N/A | 8978 | 8997 | GGGAAAATGACGCAGTCCAG | 80 | 1901 |
| 1103506 | N/A | N/A | 9076 | 9095 | GCGCACCCAAGGACTCACCA | 115 | 1902 |
| 1103522 | N/A | N/A | 9240 | 9259 | CTGAACTGAGTCAGCACTGA | 90 | 1903 |
| 1103538 | N/A | N/A | 9285 | 9304 | AAACTTTATTCACTGCAAGA | 57 | 1904 |

TABLE 26-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103570 | N/A | N/A | 8537 | 8556 | GTACCCTGGTATGATAGGCT | 22 | 1905 |
| 1103586 | N/A | N/A | 8684 | 8703 | ACACTCAGAAGGGCAGTGCT | 115 | 1906 |
| 1103602 | N/A | N/A | 4002 | 4021 | CAGCCCCTTCTGCTCACAAG | 77 | 1907 |
| 1103618 | N/A | N/A | 4181 | 4200 | CCCTGGACTCCTGGCAGAAG | 98 | 1908 |
| 1103634 | N/A | N/A | 4336 | 4355 | CATCAACCTTCTCCGCTTCC | 75 | 1909 |
| 1103650 | N/A | N/A | 4411 | 4430 | ACCTGTGCTTTGCGCCCAGA | 92 | 1910 |
| 1103666 | N/A | N/A | 4566 | 4585 | TGCATGTCCTGTCAGCTCAG | 122 | 1911 |
| 1103682 | N/A | N/A | 4645 | 4664 | GCGCATCCACAAGCATACAC | 113 | 1912 |
| 1103698 | N/A | N/A | 4846 | 4865 | TTGAATACCTGCCTCAGTCT | 104 | 1913 |
| 1103714 | N/A | N/A | 5140 | 5159 | TGAGGAGTAGAGGGCCACTG | 64 | 1914 |
| 1103730 | N/A | N/A | 5353 | 5372 | TCTGAGTGTCTCTCTCAGTC | 135 | 1915 |
| 1103746 | N/A | N/A | 5422 | 5441 | TCCCTTAGTGTCTTTCTGTT | 101 | 1916 |
| 1103762 | N/A | N/A | 5494 | 5513 | CCCCACGCCATTGTGTCCTC | 85 | 1917 |
| 1103778 | N/A | N/A | 5780 | 5799 | CCCATTCTCTTGTACAGAGC | 72 | 1918 |
| 1103794 | N/A | N/A | 5862 | 5881 | CCCTGGGCAAGCCATCTCAC | 80 | 1919 |
| 1103810 | N/A | N/A | 5948 | 5967 | AACAGAACAGTATCAGCTAC | 82 | 1920 |
| 1103826 | N/A | N/A | 5980 | 5999 | GTAAGGTAATCCATGAAAAG | 73 | 1921 |
| 1103842 | N/A | N/A | 6112 | 6131 | GGCTCCCAAGTGAGATGTGC | 118 | 1922 |
| 1103858 | N/A | N/A | 6207 | 6226 | CTTCCAGGTCAGACACCTCT | 75 | 1923 |
| 1103874 | N/A | N/A | 6269 | 6288 | ATAAGCTCTGAGCTGTGGTG | 50 | 1924 |
| 1103890 | N/A | N/A | 6317 | 6336 | AGCCCAAATGCCCCCTCTAC | 77 | 1925 |
| 1103906 | N/A | N/A | 6449 | 6468 | CAGCTAGGTGCCCTGGCTAG | 131 | 1926 |
| 1103922 | N/A | N/A | 6531 | 6550 | CCCTGCCTGCAGGGAGGTCC | 69 | 1927 |
| 1103938 | N/A | N/A | 6970 | 6989 | CAGTGCCACAGAATCCAGAA | 94 | 1928 |
| 1103954 | N/A | N/A | 7104 | 7123 | CCCCAGTTAACCCCAGGACG | 130 | 1929 |
| 1103970 | N/A | N/A | 7337 | 7356 | TCCCCGTCCTGCCCTGGCCG | 65 | 1930 |
| 1103986 | N/A | N/A | 7454 | 7473 | GCCCCAGGCCCCGCCTCTAG | 174 | 1931 |
| 1104002 | N/A | N/A | 7824 | 7843 | CAGTCCCTGAAGGGAGCAAG | 113 | 1932 |
| 1104018 | N/A | N/A | 7958 | 7977 | GCCTAATCAATATTGGTTGA | 71 | 1933 |
| 1104034 | N/A | N/A | 8041 | 8060 | TGAGGTGAGGAGTCCAATCT | 69 | 1934 |
| 1104050 | N/A | N/A | 8107 | 8126 | CTGAAGGAAGATGGAAAAGG | 78 | 1935 |
| 1104066 | N/A | N/A | 8254 | 8273 | GGCCATCATGACAACTTGAA | 105 | 1936 |
| 1104082 | N/A | N/A | 9378 | 9397 | TAATTTAGCTCCCCCCTCCC | 106 | 1937 |
| 1104098 | N/A | N/A | 9418 | 9437 | CTTAGCTAAGAATCATTTCA | 96 | 1938 |
| 1104114 | N/A | N/A | 9457 | 9476 | TCCTAAATATTCTAGTCCAG | 63 | 1939 |
| 1104130 | N/A | N/A | 9513 | 9532 | AGCCTGGTTAGCCTTTCTGA | 68 | 1940 |

TABLE 26-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104146 | N/A | N/A | 9538 | 9557 | TTTGGCAGTATTACCTCTAC | 73 | 1941 |
| 1104162 | N/A | N/A | 9562 | 9581 | TTAGTGACCTGTGACTATCT | 92 | 1942 |
| 1104178 | N/A | N/A | 9582 | 9601 | CTCTGCCATTTATCTGTGCT | 48 | 1943 |
| 1104194 | N/A | N/A | 9675 | 9694 | TTAACTAAAATAAAGGCTGT | 132 | 1944 |
| 1104210 | N/A | N/A | 9810 | 9829 | TCAAGAAGTCCCAACTTAGC | 74 | 1945 |
| 1104226 | N/A | N/A | 10560 | 10579 | AGCACGGTATTGAAATCAGG | 77 | 1946 |
| 1104242 | N/A | N/A | 10656 | 10675 | TGCTGCTGCCAGAGTCCTGG | 89 | 1947 |
| 1104258 | N/A | N/A | 10773 | 10792 | CATGCCCGGCTTCCCCATCG | 98 | 1948 |
| 1104274 | N/A | N/A | 10923 | 10942 | CTTACCTCTCCATCCCGCAT | 100 | 1949 |
| 1104290 | N/A | N/A | 11088 | 11107 | GAGGAAACGGAATTACATTC | 95 | 1950 |
| 1104306 | N/A | N/A | 11154 | 11173 | TGTATTAGGATCCCATCTAG | 135 | 1951 |
| 1104322 | N/A | N/A | 11232 | 11251 | TGAAAGCTACTAACTTTAAT | 75 | 1952 |
| 1104338 | N/A | N/A | 11312 | 11331 | ATTCCCCTGGTAGTTTCCTT | 97 | 1953 |
| 1104354 | N/A | N/A | 11393 | 11412 | GCGAGTGGTAAGCTGCTGGA | 57 | 1954 |
| 1104370 | N/A | N/A | 11523 | 11542 | AGGCTGTGTAACCTTGGGAA | 75 | 1955 |

TABLE 27

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1103155 | 110 | 129 | 3558 | 3577 | CATCATCTCCCCTGAGGAGA | 90 | 1956 |
| 1103171 | 380 | 399 | 3828 | 3847 | CTTGGTGGGCTCCTTGGCCC | 103 | 1957 |
| 1103187 | 577 | 596 | N/A | N/A | TCTGCTTCCTGTCTATAGGC | 33* | 1958 |
| 1103203 | 764 | 783 | 5650 | 5669 | GCGGATCTCTTTCAGGGCTG | 65 | 1959 |
| 1103219 | 1220 | 1239 | N/A | N/A | TTCTCGAATCTGCAGGTTGG | 111 | 1960 |
| 1103235 | 1361 | 1380 | 11650 | 11669 | CAGGTGGGTCCTGCCTCACA | 147 | 1961 |
| 1103251 | 1533 | 1552 | 11822 | 11841 | TCTGGCAGGCCTGATACTGA | 134 | 1962 |
| 1103267 | 1681 | 1700 | 11970 | 11989 | GAGGGCGATGTAGTAGGTGC | 66 | 1963 |
| 1103283 | 1768 | 1787 | 12057 | 12076 | GGAAACTCAAAGGCACAGTT | 72 | 1964 |
| 1103299 | 1870 | 1889 | 12159 | 12178 | CTCATAAAAACCAAAAGACA | 128 | 1965 |
| 1103315 | 1890 | 1909 | 12179 | 12198 | GCAGCATAGGGATATCCCAC | 89 | 1966 |
| 1103331 | 2107 | 2126 | 12396 | 12415 | CTGAGACACTTGAGTCATCG | 45 | 1967 |
| 1103347 | 2334 | 2353 | 12623 | 12642 | GCCTCCTCCTCCATCTCTAC | 53 | 1968 |
| 1103363 | 2440 | 2459 | 12729 | 12748 | CAGCATCTTCAAGAGGATGA | 109 | 1969 |

TABLE 27-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103379 | 2488 | 2507 | 12777 | 12796 | CAAAGTCATGCCCTGCCCCC | 94 | 1970 |
| 1103395 | 2527 | 2546 | 12816 | 12835 | TGGTATGACACAGCAAGGAA | 48 | 1971 |
| 1103411 | 2676 | 2695 | 12965 | 12984 | TTTTGTGTGTGAGTAAGAAG | 43 | 1972 |
| 1103427 | 2750 | 2769 | 13039 | 13058 | GCCAGTGTCTTCACTTTGCT | 73 | 1973 |
| 1103443 | 3013 | 3032 | 13302 | 13321 | CAGTGCCCTGAAGATTAGCA | 68 | 1974 |
| 1103459 | N/A | N/A | 8741 | 8760 | GTCTTTGGTGCTTTTGCCCC | 51 | 1975 |
| 1103475 | N/A | N/A | 8815 | 8834 | ATCTGGTGAGCCTGTATTGG | 45 | 1976 |
| 1103491 | N/A | N/A | 8979 | 8998 | TGGGAAAATGACGCAGTCCA | 61 | 1977 |
| 1103507 | N/A | N/A | 9091 | 9110 | CAGAGCAGCTCCACTGCGCA | 127 | 1978 |
| 1103523 | N/A | N/A | 9241 | 9260 | TCTGAACTGAGTCAGCACTG | 84 | 1979 |
| 1103539 | N/A | N/A | 9286 | 9305 | AAAACTTTATTCACTGCAAG | 64 | 1980 |
| 1103555 | N/A | N/A | 8369 | 8388 | ACCTCGAATCTGCAGGTTGG | 130 | 1981 |
| 1103571 | N/A | N/A | 8538 | 8557 | AGTACCCTGGTATGATAGGC | 33 | 1982 |
| 1103587 | N/A | N/A | 8714 | 8733 | GACAAGCAGTTAAAAAAACA | 62 | 1983 |
| 1103603 | N/A | N/A | 4003 | 4022 | TCAGCCCCTTCTGCTCACAA | 58 | 1984 |
| 1103619 | N/A | N/A | 4210 | 4229 | CTTTCCCCAGTAGGGAGGTG | 86 | 1985 |
| 1103635 | N/A | N/A | 4343 | 4362 | TCATGGACATCAACCTTCTC | 87 | 1986 |
| 1103651 | N/A | N/A | 4414 | 4433 | GTCACCTGTGCTTTGCGCCC | 107 | 1987 |
| 1103667 | N/A | N/A | 4568 | 4587 | CATGCATGTCCTGTCAGCTC | 72 | 1988 |
| 1103683 | N/A | N/A | 4646 | 4665 | GGCGCATCCACAAGCATACA | 112 | 1989 |
| 1103699 | N/A | N/A | 4855 | 4874 | TGAGGACACTTGAATACCTG | 67 | 1990 |
| 1103715 | N/A | N/A | 5163 | 5182 | GCTTCCTGGAGTGGCAGGAG | 109* | 1991 |
| 1103731 | N/A | N/A | 5362 | 5381 | TCTCCTCTCTCTGAGTGTCT | 69 | 1992 |
| 1103747 | N/A | N/A | 5424 | 5443 | TCTCCCTTAGTGTCTTTCTG | 65 | 1993 |
| 1103763 | N/A | N/A | 5499 | 5518 | GGGTTCCCCACGCCATTGTG | 109 | 1994 |
| 1103779 | N/A | N/A | 5782 | 5801 | CCCCCATTCTCTTGTACAGA | 136 | 1995 |
| 1103795 | N/A | N/A | 5881 | 5900 | AGCAATAGTGCCTGTGTGAC | 69 | 1996 |
| 1103811 | N/A | N/A | 5949 | 5968 | GAACAGAACAGTATCAGCTA | 91 | 1997 |
| 1103827 | N/A | N/A | 5981 | 6000 | AGTAAGGTAATCCATGAAAA | 109 | 1998 |
| 1103843 | N/A | N/A | 6113 | 6132 | AGGCTCCCAAGTGAGATGTG | 89 | 1999 |
| 1103859 | N/A | N/A | 6214 | 6233 | ATCACACCTTCCAGGTCAGA | 68 | 2000 |
| 1103875 | N/A | N/A | 6271 | 6290 | ATATAAGCTCTGAGCTGTGG | 87 | 2001 |
| 1103891 | N/A | N/A | 6318 | 6337 | TAGCCCAAATGCCCCCTCTA | 101 | 2002 |
| 1103907 | N/A | N/A | 6454 | 6473 | CTCCTCAGCTAGGTGCCCTG | 66 | 2003 |
| 1103923 | N/A | N/A | 6534 | 6553 | CTCCCCTGCCTGCAGGGAGG | 124 | 2004 |
| 1103939 | N/A | N/A | 6975 | 6994 | ATGAACAGTGCCACAGAATC | 124 | 2005 |

TABLE 27-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103955 | N/A | N/A | 7105 | 7124 | ACCCCAGTTAACCCCAGGAC | 90 | 2006 |
| 1103971 | N/A | N/A | 7339 | 7358 | CGTCCCCGTCCTGCCCTGGC | 93 | 2007 |
| 1103987 | N/A | N/A | 7473 | 7492 | TTTCGAGGCCCGGCCCCCGG | 78 | 2008 |
| 1104003 | N/A | N/A | 7829 | 7848 | AGACTCAGTCCCTGAAGGGA | 89 | 2009 |
| 1104019 | N/A | N/A | 7959 | 7978 | GGCCTAATCAATATTGGTTG | 80 | 2010 |
| 1104035 | N/A | N/A | 8043 | 8062 | GGTGAGGTGAGGAGTCCAAT | 62 | 2011 |
| 1104051 | N/A | N/A | 8116 | 8135 | CATGTCTATCTGAAGGAAGA | 159 | 2012 |
| 1104067 | N/A | N/A | 8283 | 8302 | GGACACCCCTAGGCTGGGTC | 121 | 2013 |
| 1104083 | N/A | N/A | 9384 | 9403 | AAAAAGTAATTTAGCTCCCC | 108 | 2014 |
| 1104099 | N/A | N/A | 9419 | 9438 | CCTTAGCTAAGAATCATTTC | 76 | 2015 |
| 1104115 | N/A | N/A | 9458 | 9477 | GTCCTAAATATTCTAGTCCA | 55 | 2016 |
| 1104131 | N/A | N/A | 9514 | 9533 | CAGCCTGGTTAGCCTTTCTG | 38 | 2017 |
| 1104147 | N/A | N/A | 9539 | 9558 | ATTTGGCAGTATTACCTCTA | 51 | 2018 |
| 1104163 | N/A | N/A | 9563 | 9582 | TTTAGTGACCTGTGACTATC | 108 | 2019 |
| 1104179 | N/A | N/A | 9583 | 9602 | TCTCTGCCATTTATCTGTGC | 48 | 2020 |
| 1104195 | N/A | N/A | 9676 | 9695 | ATTAACTAAAATAAAGGCTG | 90 | 2021 |
| 1104211 | N/A | N/A | 9811 | 9830 | CTCAAGAAGTCCCAACTTAG | 83 | 2022 |
| 1104227 | N/A | N/A | 10562 | 10581 | CCAGCACGGTATTGAAATCA | 50 | 2023 |
| 1104243 | N/A | N/A | 10659 | 10678 | TAGTGCTGCTGCCAGAGTCC | 54 | 2024 |
| 1104259 | N/A | N/A | 10777 | 10796 | CTCCCATGCCCGGCTTCCCC | 147 | 2025 |
| 1104275 | N/A | N/A | 10981 | 11000 | TGGCCTGGCCTTGAGAATCC | 108 | 2026 |
| 1104291 | N/A | N/A | 11100 | 11119 | TATGGAGGGACTGAGGAAAC | 107 | 2027 |
| 1104307 | N/A | N/A | 11155 | 11174 | GTGTATTAGGATCCCATCTA | 19 | 2028 |
| 1104323 | N/A | N/A | 11233 | 11252 | GTGAAAGCTACTAACTTTAA | 51 | 2029 |
| 1104339 | N/A | N/A | 11325 | 11344 | ATCCCTCTTCCCATTCCCC | 128 | 2030 |
| 1104355 | N/A | N/A | 11394 | 11413 | GGCGAGTGGTAAGCTGCTGG | 99 | 2031 |
| 1104371 | N/A | N/A | 11525 | 11544 | CGAGGCTGTGTAACCTTGGG | 99 | 2032 |

TABLE 28

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTCCTCAGCG | 14 | 517 |
| 1103156 | 142 | 161 | 3590 | 3609 | CCCAGACGGCGGCCAGGAGC | 113 | 2033 |

TABLE 28-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103172 | 408 | 427 | 3856 | 3875 | GCAGCTCAGCCTGGTAGACG | 92 | 2034 |
| 1103188 | 582 | 601 | N/A | N/A | CTTCATCTGCTTCCTGTCTA | 23* | 2035 |
| 1103204 | 829 | 848 | N/A | N/A | AACTTGGAGCGGTACCACTC | 106 | 2036 |
| 1103220 | 1249 | 1268 | 10863 | 10882 | TCTGACACAGACTTGGTGTC | 110 | 2037 |
| 1103236 | 1397 | 1416 | 11686 | 11705 | CTGCTCGGGCCCCTCATGAG | 18 | 2038 |
| 1103252 | 1534 | 1553 | 11823 | 11842 | GTCTGGCAGGCCTGATACTG | 84 | 2039 |
| 1103268 | 1682 | 1701 | 11971 | 11990 | GGAGGGCGATGTAGTAGGTG | 31 | 2040 |
| 1103284 | 1798 | 1817 | 12087 | 12106 | CTGAGTCTCAGTTTTCCTCC | 48 | 2041 |
| 1103300 | 1871 | 1890 | 12160 | 12179 | CCTCATAAAAACCAAAAGAC | 76 | 2042 |
| 1103316 | 1891 | 1910 | 12180 | 12199 | GGCAGCATAGGGATATCCCA | 74 | 2043 |
| 1103332 | 2108 | 2127 | 12397 | 12416 | ACTGAGACACTTGAGTCATC | 77 | 2044 |
| 1103348 | 2339 | 2358 | 12628 | 12647 | CAATTGCCTCCTCCTCCATC | 91 | 2045 |
| 1103364 | 2444 | 2463 | 12733 | 12752 | GTTTCAGCATCTTCAAGAGG | 63 | 2046 |
| 1103380 | 2489 | 2508 | 12778 | 12797 | ACAAAGTCATGCCCTGCCCC | 89 | 2047 |
| 1103396 | 2528 | 2547 | 12817 | 12836 | CTGGTATGACACAGCAAGGA | 67 | 2048 |
| 1103412 | 2677 | 2696 | 12966 | 12985 | ATTTTGTGTGTGAGTAAGAA | 49 | 2049 |
| 1103428 | 2752 | 2771 | 13041 | 13060 | GAGCCAGTGTCTTCACTTTG | 38 | 2050 |
| 1103444 | 3014 | 3033 | 13303 | 13322 | GCAGTGCCCTGAAGATTAGC | 88 | 2051 |
| 1103460 | N/A | N/A | 8746 | 8765 | TCCCCGTCTTTGGTGCTTTT | 74 | 2052 |
| 1103476 | N/A | N/A | 8823 | 8842 | CATTTACAATCTGGTGAGCC | 103 | 2053 |
| 1103492 | N/A | N/A | 8981 | 9000 | CCTGGGAAAATGACGCAGTC | 88 | 2054 |
| 1103508 | N/A | N/A | 9103 | 9122 | GCTCAGAGGCCCCAGAGCAG | 117 | 2055 |
| 1103524 | N/A | N/A | 9242 | 9261 | CTCTGAACTGAGTCAGCACT | 93 | 2056 |
| 1103540 | N/A | N/A | 9288 | 9307 | ATAAAACTTTATTCACTGCA | 82 | 2057 |
| 1103556 | N/A | N/A | 8397 | 8416 | GCCCTTCCCACGAGGCCCTG | 102 | 2058 |
| 1103572 | N/A | N/A | 8540 | 8559 | GAAGTACCCTGGTATGATAG | 80 | 2059 |
| 1103588 | N/A | N/A | 8715 | 8734 | TGACAAGCAGTTAAAAAAAC | 98 | 2060 |
| 1103604 | N/A | N/A | 4004 | 4023 | TTCAGCCCCTTCTGCTCACA | 97 | 2061 |
| 1103620 | N/A | N/A | 4212 | 4231 | TGCTTTCCCCAGTAGGGAGG | 52 | 2062 |
| 1103636 | N/A | N/A | 4351 | 4370 | AATCTCCCTCATGGACATCA | 102 | 2063 |
| 1103652 | N/A | N/A | 4421 | 4440 | GCAGGCAGTCACCTGTGCTT | 84 | 2064 |
| 1103668 | N/A | N/A | 4576 | 4595 | AAGGCACACATGCATGTCCT | 103 | 2065 |
| 1103684 | N/A | N/A | 4663 | 4682 | CTGCTTCTGCTCACACAGGC | 109 | 2066 |
| 1103700 | N/A | N/A | 4856 | 4875 | CTGAGGACACTTGAATACCT | 120 | 2067 |
| 1103716 | N/A | N/A | 5165 | 5184 | CTGCTTCCTGGAGTGGCAGG | 123* | 2068 |
| 1103732 | N/A | N/A | 5363 | 5382 | CTCTCCTCTCTCTGAGTGTC | 100 | 2069 |

TABLE 28-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103748 | N/A | N/A | 5432 | 5451 | TCTTTCCGTCTCCCTTAGTG | 94 | 2070 |
| 1103764 | N/A | N/A | 5518 | 5537 | AGGGTACAGGCCACAGCTGG | 101 | 2071 |
| 1103780 | N/A | N/A | 5785 | 5804 | CTTCCCCCATTCTCTTGTAC | 106 | 2072 |
| 1103796 | N/A | N/A | 5883 | 5902 | AAAGCAATAGTGCCTGTGTG | 80 | 2073 |
| 1103812 | N/A | N/A | 5950 | 5969 | AGAACAGAACAGTATCAGCT | 96 | 2074 |
| 1103828 | N/A | N/A | 5982 | 6001 | TAGTAAGGTAATCCATGAAA | 110 | 2075 |
| 1103844 | N/A | N/A | 6126 | 6145 | AGGCATGGAATGCAGGCTCC | 103 | 2076 |
| 1103860 | N/A | N/A | 6215 | 6234 | TATCACACCTTCCAGGTCAG | 102 | 2077 |
| 1103876 | N/A | N/A | 6272 | 6291 | CATATAAGCTCTGAGCTGTG | 91 | 2078 |
| 1103892 | N/A | N/A | 6319 | 6338 | CTAGCCCAAATGCCCCCTCT | 103 | 2079 |
| 1103908 | N/A | N/A | 6456 | 6475 | CACTCCTCAGCTAGGTGCCC | 104 | 2080 |
| 1103924 | N/A | N/A | 6535 | 6554 | TCTCCCCTGCCTGCAGGGAG | 111 | 2081 |
| 1103940 | N/A | N/A | 6977 | 6996 | GAATGAACAGTGCCACAGAA | 94 | 2082 |
| 1103956 | N/A | N/A | 7106 | 7125 | CACCCCAGTTAACCCCAGGA | 102 | 2083 |
| 1103972 | N/A | N/A | 7340 | 7359 | CCGTCCCCGTCCTGCCCTGG | 90 | 2084 |
| 1103988 | N/A | N/A | 7474 | 7493 | GTTTCGAGGCCCGGCCCCCG | 117 | 2085 |
| 1104004 | N/A | N/A | 7831 | 7850 | AAAGACTCAGTCCCTGAAGG | 119 | 2086 |
| 1104020 | N/A | N/A | 7960 | 7979 | AGGCCTAATCAATATTGGTT | 112 | 2087 |
| 1104036 | N/A | N/A | 8044 | 8063 | GGGTGAGGTGAGGAGTCCAA | 68 | 2088 |
| 1104052 | N/A | N/A | 8117 | 8136 | GCATGTCTATCTGAAGGAAG | 94 | 2089 |
| 1104068 | N/A | N/A | 8289 | 8308 | TGCCTGGGACACCCCTAGGC | 122 | 2090 |
| 1104084 | N/A | N/A | 9385 | 9404 | TAAAAAGTAATTTAGCTCCC | 91 | 2091 |
| 1104100 | N/A | N/A | 9427 | 9446 | ATTTTGTTCCTTAGCTAAGA | 96 | 2092 |
| 1104116 | N/A | N/A | 9459 | 9478 | GGTCCTAAATATTCTAGTCC | 35 | 2093 |
| 1104132 | N/A | N/A | 9515 | 9534 | TCAGCCTGGTTAGCCTTTCT | 37 | 2094 |
| 1104148 | N/A | N/A | 9540 | 9559 | GATTTGGCAGTATTACCTCT | 52 | 2095 |
| 1104164 | N/A | N/A | 9564 | 9583 | CTTTAGTGACCTGTGACTAT | 84 | 2096 |
| 1104180 | N/A | N/A | 9588 | 9607 | ACTTCTCTCTGCCATTTATC | 110 | 2097 |
| 1104196 | N/A | N/A | 9677 | 9696 | AATTAACTAAAATAAAGGCT | 108 | 2098 |
| 1104212 | N/A | N/A | 9820 | 9839 | AGACCAGAGCTCAAGAAGTC | 119 | 2099 |
| 1104228 | N/A | N/A | 10563 | 10582 | CCCAGCACGGTATTGAAATC | 84 | 2100 |
| 1104244 | N/A | N/A | 10660 | 10679 | ATAGTGCTGCTGCCAGAGTC | 88 | 2101 |
| 1104260 | N/A | N/A | 10779 | 10798 | CTCTCCCATGCCCGGCTTCC | 112 | 2102 |
| 1104276 | N/A | N/A | 10983 | 11002 | CATGGCCTGGCCTTGAGAAT | 31 | 2103 |
| 1104292 | N/A | N/A | 11115 | 11134 | CCCCTTAGAACAGCCTATGG | 111 | 2104 |
| 1104308 | N/A | N/A | 11156 | 11175 | TGTGTATTAGGATCCCATCT | 41 | 2105 |

TABLE 28-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104324 | N/A | N/A | 11234 | 11253 | AGTGAAAGCTACTAACTTTA | 78 | 2106 |
| 1104340 | N/A | N/A | 11326 | 11345 | AATCCCTCTTCCCATTCCC | 105 | 2107 |
| 1104356 | N/A | N/A | 11396 | 11415 | CTGGCGAGTGGTAAGCTGCT | 91 | 2108 |
| 1104372 | N/A | N/A | 11535 | 11554 | TCCACCACCACGAGGCTGTG | 101 | 2109 |

TABLE 29

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1103157 | 158 | 177 | 3606 | 3625 | GAGGCGGGTGCCAGGACCCA | 45 | 2110 |
| 1103173 | 409 | 428 | 3857 | 3876 | CGCAGCTCAGCCTGGTAGAC | 97 | 2111 |
| 1103189 | 636 | 655 | 5225 | 5244 | TCTCCTCCTCCAGCGACTCA | 92 | 2112 |
| 1103205 | 843 | 862 | N/A | N/A | CTGTCAGGTCTGCAAACTTG | 74 | 2113 |
| 1103221 | 1263 | 1282 | 10877 | 10896 | TCTTGAGGTGGCCTTCTGAC | 104 | 2114 |
| 1103237 | 1399 | 1418 | 11688 | 11707 | TTCTGCTCGGGCCCCTCATG | 75 | 2115 |
| 1103253 | 1544 | 1563 | 11833 | 11852 | GGTGGGTGCCGTCTGGCAGG | 34 | 2116 |
| 1103269 | 1683 | 1702 | 11972 | 11991 | TGGAGGGCGATGTAGTAGGT | 58 | 2117 |
| 1103285 | 1800 | 1819 | 12089 | 12108 | GTCTGAGTCTCAGTTTTCCT | 25 | 2118 |
| 1103301 | 1872 | 1891 | 12161 | 12180 | ACCTCATAAAAACCAAAAGA | 116 | 2119 |
| 1103317 | 1893 | 1912 | 12182 | 12201 | TAGGCAGCATAGGGATATCC | 101 | 2120 |
| 1103333 | 2110 | 2129 | 12399 | 12418 | GGACTGAGACACTTGAGTCA | 96 | 2121 |
| 1103349 | 2348 | 2367 | 12637 | 12656 | GCGCCATCCCAATTGCCTCC | 98 | 2122 |
| 1103365 | 2446 | 2465 | 12735 | 12754 | CTGTTTCAGCATCTTCAAGA | 41 | 2123 |
| 1103381 | 2493 | 2512 | 12782 | 12801 | TGGGACAAAGTCATGCCCTG | 105 | 2124 |
| 1103397 | 2530 | 2549 | 12819 | 12838 | GCCTGGTATGACACAGCAAG | 85 | 2125 |
| 1103413 | 2697 | 2716 | 12986 | 13005 | CTACCTAGAATACTGGGTAC | 110 | 2126 |
| 1103429 | 2753 | 2772 | 13042 | 13061 | TGAGCCAGTGTCTTCACTTT | 70 | 2127 |
| 1103445 | 3015 | 3034 | 13304 | 13323 | AGCAGTGCCCTGAAGATTAG | 86 | 2128 |
| 1103461 | N/A | N/A | 8748 | 8767 | TTTCCCCGTCTTTGGTGCTT | 77 | 2129 |
| 1103477 | N/A | N/A | 8824 | 8843 | CCATTTACAATCTGGTGAGC | 61 | 2130 |
| 1103493 | N/A | N/A | 8982 | 9001 | TCCTGGGAAAATGACGCAGT | 114 | 2131 |
| 1103509 | N/A | N/A | 9142 | 9161 | TCCCAGTGACAGGAAGAGGT | 105 | 2132 |
| 1103525 | N/A | N/A | 9245 | 9264 | ATCCTCTGAACTGAGTCAGC | 93 | 2133 |
| 1103541 | N/A | N/A | 9292 | 9311 | GAACATAAAACTTTATTCAC | 110 | 2134 |

TABLE 29-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103557 | N/A | N/A | 8403 | 8422 | TCCAGTGCCCTTCCCACGAG | 104 | 2135 |
| 1103573 | N/A | N/A | 8542 | 8561 | TAGAAGTACCCTGGTATGAT | 110 | 2136 |
| 1103589 | N/A | N/A | 8728 | 8747 | TTGCCCCTGTAGTGACAAG | 103 | 2137 |
| 1103605 | N/A | N/A | 4005 | 4024 | ATTCAGCCCCTTCTGCTCAC | 106 | 2138 |
| 1103621 | N/A | N/A | 4213 | 4232 | CTGCTTTCCCCAGTAGGGAG | 94 | 2139 |
| 1103637 | N/A | N/A | 4367 | 4386 | CTTCACCCCAGAATCCAATC | 124 | 2140 |
| 1103653 | N/A | N/A | 4423 | 4442 | TGGCAGGCAGTCACCTGTGC | 130 | 2141 |
| 1103669 | N/A | N/A | 4577 | 4596 | GAAGGCACACATGCATGTCC | 103 | 2142 |
| 1103685 | N/A | N/A | 4665 | 4684 | ACCTGCTTCTGCTCACACAG | 96 | 2143 |
| 1103701 | N/A | N/A | 4858 | 4877 | TTCTGAGGACACTTGAATAC | 128 | 2144 |
| 1103717 | N/A | N/A | 5166 | 5185 | TCTGCTTCCTGGAGTGGCAG | 111* | 2145 |
| 1103733 | N/A | N/A | 5364 | 5383 | TCTCTCCTCTCTCTGAGTGT | 100 | 2146 |
| 1103749 | N/A | N/A | 5440 | 5459 | CTCTTGTCTCTTTCCGTCTC | 105 | 2147 |
| 1103765 | N/A | N/A | 5535 | 5554 | AAGCGGTACCAGGGCTCAGG | 62 | 2148 |
| 1103781 | N/A | N/A | 5810 | 5829 | TATTCTCCCAGCTTCCTCCA | 112 | 2149 |
| 1103797 | N/A | N/A | 5888 | 5907 | TTTTGAAAGCAATAGTGCCT | 94 | 2150 |
| 1103813 | N/A | N/A | 5951 | 5970 | TAGAACAGAACAGTATCAGC | 92 | 2151 |
| 1103829 | N/A | N/A | 5989 | 6008 | TACTTCATAGTAAGGTAATC | 112 | 2152 |
| 1103845 | N/A | N/A | 6144 | 6163 | CCCAAAACAGACTGGCAGAG | 79 | 2153 |
| 1103861 | N/A | N/A | 6216 | 6235 | ATATCACACCTTCCAGGTCA | 87 | 2154 |
| 1103877 | N/A | N/A | 6273 | 6292 | ACATATAAGCTCTGAGCTGT | 105 | 2155 |
| 1103893 | N/A | N/A | 6333 | 6352 | CGTGCCTGTCCTGCCTAGCC | 90 | 2156 |
| 1103909 | N/A | N/A | 6457 | 6476 | ACACTCCTCAGCTAGGTGCC | 87 | 2157 |
| 1103925 | N/A | N/A | 6536 | 6555 | TTCTCCCCTGCCTGCAGGGA | 120 | 2158 |
| 1103941 | N/A | N/A | 6978 | 6997 | TGAATGAACAGTGCCACAGA | 112 | 2159 |
| 1103957 | N/A | N/A | 7107 | 7126 | GCACCCCAGTTAACCCCAGG | 93 | 2160 |
| 1103973 | N/A | N/A | 7341 | 7360 | CCCGTCCCCGTCCTGCCCTG | 98 | 2161 |
| 1103989 | N/A | N/A | 7476 | 7495 | AGGTTTCGAGGCCCGGCCCC | 93 | 2162 |
| 1104005 | N/A | N/A | 7851 | 7870 | GATCTGCACACAAGGCTGAA | 99 | 2163 |
| 1104021 | N/A | N/A | 7961 | 7980 | GAGGCCTAATCAATATTGGT | 111 | 2164 |
| 1104037 | N/A | N/A | 8047 | 8066 | GATGGGTGAGGTGAGGAGTC | 40 | 2165 |
| 1104053 | N/A | N/A | 8118 | 8137 | CGCATGTCTATCTGAAGGAA | 90 | 2166 |
| 1104069 | N/A | N/A | 8325 | 8344 | TCCTGAAAGAAAGCAGAGGG | 114 | 2167 |
| 1104085 | N/A | N/A | 9386 | 9405 | GTAAAAAGTAATTTAGCTCC | 127 | 2168 |
| 1104101 | N/A | N/A | 9428 | 9447 | AATTTTGTTCCTTAGCTAAG | 125 | 2169 |
| 1104117 | N/A | N/A | 9460 | 9479 | TGGTCCTAAATATTCTAGTC | 74 | 2170 |

TABLE 29-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104133 | N/A | N/A | 9516 | 9535 | GTCAGCCTGGTTAGCCTTTC | 30 | 2171 |
| 1104149 | N/A | N/A | 9541 | 9560 | GGATTTGGCAGTATTACCTC | 52 | 2172 |
| 1104165 | N/A | N/A | 9565 | 9584 | GCTTTAGTGACCTGTGACTA | 43 | 2173 |
| 1104181 | N/A | N/A | 9589 | 9608 | TACTTCTCTCTGCCATTTAT | 75 | 2174 |
| 1104197 | N/A | N/A | 9678 | 9697 | CAATTAACTAAAATAAAGGC | 130 | 2175 |
| 1104213 | N/A | N/A | 9828 | 9847 | GGATCAGGAGACCAGAGCTC | 118 | 2176 |
| 1104229 | N/A | N/A | 10564 | 10583 | ACCCAGCACGGTATTGAAAT | 105 | 2177 |
| 1104245 | N/A | N/A | 10670 | 10689 | CCAAATCCCAATAGTGCTGC | 80 | 2178 |
| 1104261 | N/A | N/A | 10782 | 10801 | ATCCTCTCCCATGCCCGGCT | 87 | 2179 |
| 1104277 | N/A | N/A | 11006 | 11025 | TGTGCCAGCCCCAGGCTTTC | 125 | 2180 |
| 1104293 | N/A | N/A | 11119 | 11138 | GGCTCCCCTTAGAACAGCCT | 115 | 2181 |
| 1104309 | N/A | N/A | 11158 | 11177 | AGTGTGTATTAGGATCCCAT | 18 | 2182 |
| 1104325 | N/A | N/A | 11235 | 11254 | AAGTGAAAGCTACTAACTTT | 102 | 2183 |
| 1104341 | N/A | N/A | 11327 | 11346 | AAATCCCTCTTCCCATTCC | 110 | 2184 |
| 1104357 | N/A | N/A | 11428 | 11447 | AGATAACACTGGGAAAGCAT | 97 | 2185 |
| 1104373 | N/A | N/A | 11537 | 11556 | GGTCCACCACCACGAGGCTG | 108 | 2186 |

TABLE 30

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1103158 | 206 | 225 | 3654 | 3673 | GGAGAAATCCACCCGGGTCG | 155 | 2187 |
| 1103174 | 410 | 429 | 3858 | 3877 | TCGCAGCTCAGCCTGGTAGA | 127 | 2188 |
| 1103190 | 648 | 667 | 5237 | 5256 | TCAAGAACCGGATCTCCTCC | 63 | 2189 |
| 1103206 | 926 | 945 | 7283 | 7302 | GGTCAAGGACTGCAACTGGC | 96 | 2190 |
| 1103222 | 1270 | 1289 | 10884 | 10903 | ATGTTCCTCTTGAGGTGGCC | 86 | 2191 |
| 1103238 | 1400 | 1419 | 11689 | 11708 | CTTCTGCTCGGGCCCCTCAT | 59 | 2192 |
| 1103254 | 1573 | 1592 | 11862 | 11881 | TTCTTGTTAGTTGGAGTTGC | 33 | 2193 |
| 1103270 | 1686 | 1705 | 11975 | 11994 | ATGTGGAGGGCGATGTAGTA | 49 | 2194 |
| 1103286 | 1809 | 1828 | 12098 | 12117 | CCCTTTCCTGTCTGAGTCTC | 72 | 2195 |
| 1103302 | 1873 | 1892 | 12162 | 12181 | CACCTCATAAAAACCAAAG | 100 | 2196 |
| 1103318 | 1996 | 2015 | 12285 | 12304 | GAACAACCCTCTGAGCTGGG | 57 | 2197 |
| 1103334 | 2124 | 2143 | 12413 | 12432 | ATGGCAGCTCAGGTGGACTG | 54 | 2198 |

TABLE 30-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103350 | 2364 | 2383 | 12653 | 12672 | CCTACTTGTATGCCTAGCGC | 75 | 2199 |
| 1103366 | 2447 | 2466 | 12736 | 12755 | CCTGTTTCAGCATCTTCAAG | 42 | 2200 |
| 1103382 | 2494 | 2513 | 12783 | 12802 | ATGGGACAAAGTCATGCCCT | 98 | 2201 |
| 1103398 | 2567 | 2586 | 12856 | 12875 | AAGAAGCAGCAGTCCCAGGG | 75 | 2202 |
| 1103414 | 2700 | 2719 | 12989 | 13008 | GCACTACCTAGAATACTGGG | 76 | 2203 |
| 1103430 | 2754 | 2773 | 13043 | 13062 | ATGAGCCAGTGTCTTCACTT | 37 | 2204 |
| 1103446 | 3017 | 3036 | 13306 | 13325 | GCAGCAGTGCCCTGAAGATT | 29 | 2205 |
| 1103462 | N/A | N/A | 8749 | 8768 | TTTTCCCCGTCTTTGGTGCT | 56 | 2206 |
| 1103478 | N/A | N/A | 8825 | 8844 | TCCATTTACAATCTGGTGAG | 41 | 2207 |
| 1103494 | N/A | N/A | 8983 | 9002 | TTCCTGGGAAAATGACGCAG | 97 | 2208 |
| 1103510 | N/A | N/A | 9144 | 9163 | CCTCCCAGTGACAGGAAGAG | 104 | 2209 |
| 1103526 | N/A | N/A | 9246 | 9265 | AATCCTCTGAACTGAGTCAG | 54 | 2210 |
| 1103542 | N/A | N/A | 9293 | 9312 | GGAACATAAAACTTTATTCA | 69 | 2211 |
| 1103558 | N/A | N/A | 8405 | 8424 | ACTCCAGTGCCCTTCCCACG | 27 | 2212 |
| 1103574 | N/A | N/A | 8543 | 8562 | CTAGAAGTACCCTGGTATGA | 95 | 2213 |
| 1103590 | N/A | N/A | 8730 | 8749 | TTTTGCCCCTGTAGTGACA | 67 | 2214 |
| 1103606 | N/A | N/A | 4038 | 4057 | TCCCTGAGACTTCTCGGGCA | 110 | 2215 |
| 1103622 | N/A | N/A | 4214 | 4233 | ACTGCTTTCCCCAGTAGGGA | 77 | 2216 |
| 1103638 | N/A | N/A | 4371 | 4390 | CTTTCTTCACCCCAGAATCC | 139 | 2217 |
| 1103654 | N/A | N/A | 4424 | 4443 | GTGGCAGGCAGTCACCTGTG | 83 | 2218 |
| 1103670 | N/A | N/A | 4578 | 4597 | TGAAGGCACACATGCATGTC | 105 | 2219 |
| 1103686 | N/A | N/A | 4666 | 4685 | CACCTGCTTCTGCTCACACA | 158 | 2220 |
| 1103702 | N/A | N/A | 4960 | 4979 | CCTGACCTGTCTATAGGCAG | 92* | 2221 |
| 1103718 | N/A | N/A | 5167 | 5186 | ATCTGCTTCCTGGAGTGGCA | 102* | 2222 |
| 1103734 | N/A | N/A | 5365 | 5384 | TTCTCTCCTCTCTCTGAGTG | 102 | 2223 |
| 1103750 | N/A | N/A | 5442 | 5461 | CTCTCTTGTCTCTTTCCGTC | 69 | 2224 |
| 1103766 | N/A | N/A | 5536 | 5555 | GAAGCGGTACCAGGGCTCAG | 95 | 2225 |
| 1103782 | N/A | N/A | 5811 | 5830 | ATATTCTCCCAGCTTCCTCC | 92 | 2226 |
| 1103798 | N/A | N/A | 5893 | 5912 | GGTACTTTTGAAAGCAATAG | 47 | 2227 |
| 1103814 | N/A | N/A | 5955 | 5974 | GGCTTAGAACAGAACAGTAT | 87 | 2228 |
| 1103830 | N/A | N/A | 5996 | 6015 | CAGCACCTACTTCATAGTAA | 54 | 2229 |
| 1103846 | N/A | N/A | 6156 | 6175 | GAGGCTCAGTAACCCAAAAC | 60 | 2230 |
| 1103862 | N/A | N/A | 6217 | 6236 | AATATCACACCTTCCAGGTC | 130 | 2231 |
| 1103878 | N/A | N/A | 6275 | 6294 | CTACATATAAGCTCTGAGCT | 127 | 2232 |
| 1103894 | N/A | N/A | 6369 | 6388 | AGGAATGGCCCTCCCTTCTT | 93 | 2233 |
| 1103910 | N/A | N/A | 6458 | 6477 | CACACTCCTCAGCTAGGTGC | 75 | 2234 |

TABLE 30-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103926 | N/A | N/A | 6541 | 6560 | GCCCTTTCTCCCCTGCCTGC | 106 | 2235 |
| 1103942 | N/A | N/A | 6980 | 6999 | AATGAATGAACAGTGCCACA | 113 | 2236 |
| 1103958 | N/A | N/A | 7114 | 7133 | GTGAGCAGCACCCCAGTTAA | 117 | 2237 |
| 1103974 | N/A | N/A | 7345 | 7364 | TCCGCCCGTCCCCGTCCTGC | 119 | 2238 |
| 1103990 | N/A | N/A | 7477 | 7496 | GAGGTTTCGAGGCCCGGCCC | 129 | 2239 |
| 1104006 | N/A | N/A | 7852 | 7871 | GGATCTGCACACAAGGCTGA | 112 | 2240 |
| 1104022 | N/A | N/A | 7962 | 7981 | TGAGGCCTAATCAATATTGG | 96 | 2241 |
| 1104038 | N/A | N/A | 8050 | 8069 | AGAGATGGGTGAGGTGAGGA | 36 | 2242 |
| 1104054 | N/A | N/A | 8140 | 8159 | CTTGAGTGTTATCTGGGAGG | 61 | 2243 |
| 1104070 | N/A | N/A | 8336 | 8355 | GGGAATGGTGATCCTGAAAG | 53 | 2244 |
| 1104086 | N/A | N/A | 9388 | 9407 | AAGTAAAAAGTAATTTAGCT | 87 | 2245 |
| 1104102 | N/A | N/A | 9429 | 9448 | GAATTTTGTTCCTTAGCTAA | 80 | 2246 |
| 1104118 | N/A | N/A | 9477 | 9496 | GAGACATGCATATCTAGTGG | 23 | 2247 |
| 1104134 | N/A | N/A | 9518 | 9537 | TAGTCAGCCTGGTTAGCCTT | 63 | 2248 |
| 1104150 | N/A | N/A | 9547 | 9566 | TATCTAGGATTTGGCAGTAT | 58 | 2249 |
| 1104166 | N/A | N/A | 9567 | 9586 | GTGCTTTAGTGACCTGTGAC | 25 | 2250 |
| 1104182 | N/A | N/A | 9591 | 9610 | CCTACTTCTCTCTGCCATTT | 75 | 2251 |
| 1104198 | N/A | N/A | 9679 | 9698 | ACAATTAACTAAAATAAAGG | 95 | 2252 |
| 1104214 | N/A | N/A | 10003 | 10022 | GTAATCCCCTTACTCGGGAG | 84 | 2253 |
| 1104230 | N/A | N/A | 10565 | 10584 | AACCCAGCACGGTATTGAAA | 117 | 2254 |
| 1104246 | N/A | N/A | 10671 | 10690 | CCCAAATCCCAATAGTGCTG | 59 | 2255 |
| 1104262 | N/A | N/A | 10786 | 10805 | AGCCATCCTCTCCCATGCCC | 130 | 2256 |
| 1104278 | N/A | N/A | 11010 | 11029 | TCTATGTGCCAGCCCCAGGC | 83 | 2257 |
| 1104294 | N/A | N/A | 11120 | 11139 | AGGCTCCCCTTAGAACAGCC | 75 | 2258 |
| 1104310 | N/A | N/A | 11159 | 11178 | GAGTGTGTATTAGGATCCCA | 18 | 2259 |
| 1104326 | N/A | N/A | 11237 | 11256 | GGAAGTGAAAGCTACTAACT | 46 | 2260 |
| 1104342 | N/A | N/A | 11329 | 11348 | CCAAATCCCCTCTTCCCATT | 81 | 2261 |
| 1104358 | N/A | N/A | 11430 | 11449 | TGAGATAACACTGGGAAAGC | 89 | 2262 |
| 1104374 | N/A | N/A | 11543 | 11562 | ACCCCAGGTCCACCACCACG | 101 | 2263 |

TABLE 31

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1103159 | 218 | 237 | 3666 | 3685 | TGCCCCAGCCAGGGAGAAAT | 93 | 2264 |
| 1103175 | 411 | 430 | 3859 | 3878 | CTCGCAGCTCAGCCTGGTAG | 69 | 2265 |
| 1103191 | 652 | 671 | 5241 | 5260 | TTCCTCAAGAACCGGATCTC | 79 | 2266 |
| 1103207 | 930 | 949 | 7287 | 7306 | CGCAGGTCAAGGACTGCAAC | 84 | 2267 |
| 1103223 | 1271 | 1290 | 10885 | 10904 | GATGTTCCTCTTGAGGTGGC | 94 | 2268 |
| 1103239 | 1401 | 1420 | 11690 | 11709 | GCTTCTGCTCGGGCCCCTCA | 52 | 2269 |
| 1103255 | 1575 | 1594 | 11864 | 11883 | GTTTCTTGTTAGTTGGAGTT | 19 | 2270 |
| 1103271 | 1687 | 1706 | 11976 | 11995 | GATGTGGAGGGCGATGTAGT | 69 | 2271 |
| 1103287 | 1811 | 1830 | 12100 | 12119 | TTCCCTTTCCTGTCTGAGTC | 56 | 2272 |
| 1103303 | 1874 | 1893 | 12163 | 12182 | CCACCTCATAAAAACCAAAA | 89 | 2273 |
| 1103319 | 1997 | 2016 | 12286 | 12305 | AGAACAACCCTCTGAGCTGG | 61 | 2274 |
| 1103335 | 2183 | 2202 | 12472 | 12491 | CAAGTGCTGAGAATCAAGCT | 87 | 2275 |
| 1103351 | 2398 | 2417 | 12687 | 12706 | TCCAGAGGCCAAGTGCAACT | 57 | 2276 |
| 1103367 | 2448 | 2467 | 12737 | 12756 | TCCTGTTTCAGCATCTTCAA | 61 | 2277 |
| 1103383 | 2495 | 2514 | 12784 | 12803 | AATGGGACAAAGTCATGCCC | 88 | 2278 |
| 1103399 | 2629 | 2648 | 12918 | 12937 | AAAAGCAGCCGGTCACTATG | 100 | 2279 |
| 1103415 | 2703 | 2722 | 12992 | 13011 | AGGGCACTACCTAGAATACT | 71 | 2280 |
| 1103431 | 2789 | 2808 | 13078 | 13097 | CAGCCCTGAGCACCCGGCCT | 106 | 2281 |
| 1103447 | 3019 | 3038 | 13308 | 13327 | CAGCAGCAGTGCCCTGAAGA | 38 | 2282 |
| 1103463 | N/A | N/A | 8750 | 8769 | ATTTTCCCCGTCTTTGGTGC | 65 | 2283 |
| 1103479 | N/A | N/A | 8855 | 8874 | GGCAGGCAGCTAACCGCGAG | 80 | 2284 |
| 1103495 | N/A | N/A | 8984 | 9003 | GTTCCTGGGAAAATGACGCA | 89 | 2285 |
| 1103511 | N/A | N/A | 9146 | 9165 | GCCCTCCCAGTGACAGGAAG | 96 | 2286 |
| 1103527 | N/A | N/A | 9249 | 9268 | AAGAATCCTCTGAACTGAGT | 85 | 2287 |
| 1103543 | N/A | N/A | 9294 | 9313 | GGGAACATAAAACTTTATTC | 42 | 2288 |
| 1103559 | N/A | N/A | 8407 | 8426 | GGACTCCAGTGCCCTTCCCA | 90 | 2289 |
| 1103575 | N/A | N/A | 8544 | 8563 | CCTAGAAGTACCCTGGTATG | 64 | 2290 |
| 1103591 | N/A | N/A | 8732 | 8751 | GCTTTTGCCCCTGTAGTGA | 36 | 2291 |
| 1103607 | N/A | N/A | 4039 | 4058 | CTCCCTGAGACTTCTCGGGC | 129 | 2292 |
| 1103623 | N/A | N/A | 4216 | 4235 | GCACTGCTTTCCCCAGTAGG | 88 | 2293 |
| 1103639 | N/A | N/A | 4372 | 4391 | ACTTTCTTCACCCCAGAATC | 101 | 2294 |
| 1103655 | N/A | N/A | 4456 | 4475 | AGTCAAAGTAACTTGATGGG | 90 | 2295 |
| 1103671 | N/A | N/A | 4579 | 4598 | TTGAAGGCACACATGCATGT | 102 | 2296 |
| 1103687 | N/A | N/A | 4728 | 4747 | AGGATGAGCAGATGTGGGCT | 77 | 2297 |
| 1103703 | N/A | N/A | 4961 | 4980 | CCCTGACCTGTCTATAGGCA | 105* | 2298 |

TABLE 31-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103719 | N/A | N/A | 5169 | 5188 | TCATCTGCTTCCTGGAGTGG | 49* | 2299 |
| 1103735 | N/A | N/A | 5366 | 5385 | TTTCTCTCCTCTCTCTGAGT | 95 | 2300 |
| 1103751 | N/A | N/A | 5446 | 5465 | AATGCTCTCTTGTCTCTTTC | 83 | 2301 |
| 1103767 | N/A | N/A | 5537 | 5556 | AGAAGCGGTACCAGGGCTCA | 100 | 2302 |
| 1103783 | N/A | N/A | 5830 | 5849 | AGTCAGTCACCTGGAGAGGA | 79 | 2303 |
| 1103799 | N/A | N/A | 5898 | 5917 | TAATGGGTACTTTTGAAAGC | 100 | 2304 |
| 1103815 | N/A | N/A | 5956 | 5975 | GGGCTTAGAACAGAACAGTA | 74 | 2305 |
| 1103831 | N/A | N/A | 5997 | 6016 | ACAGCACCTACTTCATAGTA | 113 | 2306 |
| 1103847 | N/A | N/A | 6158 | 6177 | TAGAGGCTCAGTAACCCAAA | 74 | 2307 |
| 1103863 | N/A | N/A | 6218 | 6237 | CAATATCACACCTTCCAGGT | 72 | 2308 |
| 1103879 | N/A | N/A | 6277 | 6296 | CACTACATATAAGCTCTGAG | 93 | 2309 |
| 1103895 | N/A | N/A | 6370 | 6389 | TAGGAATGGCCCTCCCTTCT | 91 | 2310 |
| 1103911 | N/A | N/A | 6461 | 6480 | ACTCACACTCCTCAGCTAGG | 100 | 2311 |
| 1103927 | N/A | N/A | 6546 | 6565 | TAATAGCCCTTTCTCCCCTG | 93 | 2312 |
| 1103943 | N/A | N/A | 6982 | 7001 | CGAATGAATGAACAGTGCCA | 108 | 2313 |
| 1103959 | N/A | N/A | 7120 | 7139 | AGGGAGGTGAGCAGCACCCC | 103 | 2314 |
| 1103975 | N/A | N/A | 7347 | 7366 | GCTCCGCCCGTCCCCGTCCT | 66 | 2315 |
| 1103991 | N/A | N/A | 7478 | 7497 | GGAGGTTTCGAGGCCCGGCC | 117 | 2316 |
| 1104007 | N/A | N/A | 7853 | 7872 | GGGATCTGCACACAAGGCTG | 49 | 2317 |
| 1104023 | N/A | N/A | 7963 | 7982 | TTGAGGCCTAATCAATATTG | 110 | 2318 |
| 1104039 | N/A | N/A | 8052 | 8071 | GAAGAGATGGGTGAGGTGAG | 36 | 2319 |
| 1104055 | N/A | N/A | 8193 | 8212 | CTTTTTCCCCAGCAGCCAAC | 125 | 2320 |
| 1104071 | N/A | N/A | 9325 | 9344 | TCACATTCACTAATATTTAA | 74 | 2321 |
| 1104087 | N/A | N/A | 9389 | 9408 | CAAGTAAAAAGTAATTTAGC | 120 | 2322 |
| 1104103 | N/A | N/A | 9433 | 9452 | AGAGGAATTTTGTTCCTTAG | 98 | 2323 |
| 1104119 | N/A | N/A | 9481 | 9500 | TCCTGAGACATGCATATCTA | 82 | 2324 |
| 1104135 | N/A | N/A | 9520 | 9539 | ACTAGTCAGCCTGGTTAGCC | 66 | 2325 |
| 1104151 | N/A | N/A | 9549 | 9568 | ACTATCTAGGATTTGGCAGT | 36 | 2326 |
| 1104167 | N/A | N/A | 9569 | 9588 | CTGTGCTTTAGTGACCTGTG | 42 | 2327 |
| 1104183 | N/A | N/A | 9636 | 9655 | AGTGCTCAATACACATAGGT | 58 | 2328 |
| 1104199 | N/A | N/A | 9680 | 9699 | GACAATTAACTAAAATAAAG | 87 | 2329 |
| 1104215 | N/A | N/A | 10131 | 10150 | ACTCCGTCGAAAGCAGGCAA | 91 | 2330 |
| 1104231 | N/A | N/A | 10566 | 10585 | AAACCCAGCACGGTATTGAA | 71 | 2331 |
| 1104247 | N/A | N/A | 10694 | 10713 | TCTTCCAAACGGGCTGGAGA | 98 | 2332 |
| 1104263 | N/A | N/A | 10790 | 10809 | CATGAGCCATCCTCTCCCAT | 70 | 2333 |
| 1104279 | N/A | N/A | 11023 | 11042 | TTGCTGGGAACCTTCTATGT | 97 | 2334 |

TABLE 31-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104295 | N/A | N/A | 11121 | 11140 | AAGGCTCCCCTTAGAACAGC | 64 | 2335 |
| 1104311 | N/A | N/A | 11160 | 11179 | AGAGTGTGTATTAGGATCCC | 31 | 2336 |
| 1104327 | N/A | N/A | 11242 | 11261 | GAGTTGGAAGTGAAAGCTAC | 67 | 2337 |
| 1104343 | N/A | N/A | 11342 | 11361 | CGTGGCGGATACGCCAAATC | 96 | 2338 |
| 1104359 | N/A | N/A | 11431 | 11450 | GTGAGATAACACTGGGAAAG | 65 | 2339 |
| 1104375 | N/A | N/A | 11552 | 11571 | TTCACACAGACCCCAGGTCC | 96 | 2340 |

TABLE 32

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103160 | 221 | 240 | 3669 | 3688 | GAGTGCCCCAGCCAGGGAGA | 119 | 2341 |
| 1103176 | 442 | 461 | 3890 | 3909 | GCGGTGAGTTGATCGAGCCG | 86 | 2342 |
| 1103192 | 653 | 672 | 5242 | 5261 | CTTCCTCAAGAACCGGATCT | 81 | 2343 |
| 1103208 | 932 | 951 | 7289 | 7308 | GTCGCAGGTCAAGGACTGCA | 100 | 2344 |
| 1103224 | 1293 | 1312 | 10907 | 10926 | GCATCTCCACGGTCTTCACC | 85 | 2345 |
| 1103240 | 1403 | 1422 | 11692 | 11711 | CTGCTTCTGCTCGGGCCCCT | 80 | 2346 |
| 1103256 | 1577 | 1596 | 11866 | 11885 | GAGTTTCTTGTTAGTTGGAG | 9 | 2347 |
| 1103272 | 1700 | 1719 | 11989 | 12008 | AACAGGAATCAGGGATGTGG | 35 | 2348 |
| 1103288 | 1836 | 1855 | 12125 | 12144 | CCAGGGCTACCTTGTCTGTG | 90 | 2349 |
| 1103304 | 1878 | 1897 | 12167 | 12186 | TATCCCACCTCATAAAAACC | 88 | 2350 |
| 1103320 | 2001 | 2020 | 12290 | 12309 | TAGGAGAACAACCCTCTGAG | 62 | 2351 |
| 1103336 | 2185 | 2204 | 12474 | 12493 | CCCAAGTGCTGAGAATCAAG | 53 | 2352 |
| 1103352 | 2400 | 2419 | 12689 | 12708 | AATCCAGAGGCCAAGTGCAA | 95 | 2353 |
| 1103368 | 2452 | 2471 | 12741 | 12760 | TCTCTCCTGTTTCAGCATCT | 22 | 2354 |
| 1103384 | 2496 | 2515 | 12785 | 12804 | AAATGGGACAAAGTCATGCC | 98 | 2355 |
| 1103400 | 2637 | 2656 | 12926 | 12945 | GCTTAGGGAAAAGCAGCCGG | 51 | 2356 |
| 1103416 | 2704 | 2723 | 12993 | 13012 | TAGGGCACTACCTAGAATAC | 75 | 2357 |
| 1103432 | 2791 | 2810 | 13080 | 13099 | GTCAGCCCTGAGCACCCGGC | 116 | 2358 |
| 1103448 | 3021 | 3040 | 13310 | 13329 | GGCAGCAGCAGTGCCCTGAA | 38 | 2359 |
| 1103464 | N/A | N/A | 8752 | 8771 | TGATTTTCCCCGTCTTTGGT | 58 | 2360 |
| 1103480 | N/A | N/A | 8866 | 8885 | CGTGTCTGAGAGGCAGGCAG | 76 | 2361 |
| 1103496 | N/A | N/A | 8989 | 9008 | CTGCAGTTCCTGGGAAAATG | 70 | 2362 |
| 1103512 | N/A | N/A | 9147 | 9166 | GGCCCTCCCAGTGACAGGAA | 68 | 2363 |

TABLE 32-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103528 | N/A | N/A | 9250 | 9269 | GAAGAATCCTCTGAACTGAG | 64 | 2364 |
| 1103544 | N/A | N/A | 9295 | 9314 | AGGGAACATAAAACTTTATT | 57 | 2365 |
| 1103560 | N/A | N/A | 8408 | 8427 | AGGACTCCAGTGCCCTTCCC | 57 | 2366 |
| 1103576 | N/A | N/A | 8546 | 8565 | CACCTAGAAGTACCCTGGTA | 101 | 2367 |
| 1103592 | N/A | N/A | 8734 | 8753 | GTGCTTTTGCCCCCTGTAGT | 43 | 2368 |
| 1103608 | N/A | N/A | 4040 | 4059 | CCTCCCTGAGACTTCTCGGG | 86 | 2369 |
| 1103624 | N/A | N/A | 4217 | 4236 | TGCACTGCTTTCCCCAGTAG | 102 | 2370 |
| 1103640 | N/A | N/A | 4373 | 4392 | CACTTTCTTCACCCCAGAAT | 135 | 2371 |
| 1103656 | N/A | N/A | 4465 | 4484 | AGCTGTGCAAGTCAAAGTAA | 80 | 2372 |
| 1103672 | N/A | N/A | 4584 | 4603 | TGCACTTGAAGGCACACATG | 59 | 2373 |
| 1103688 | N/A | N/A | 4729 | 4748 | GAGGATGAGCAGATGTGGGC | 65 | 2374 |
| 1103704 | N/A | N/A | 4962 | 4981 | TCCCTGACCTGTCTATAGGC | 95* | 2375 |
| 1103720 | N/A | N/A | 5170 | 5189 | TTCATCTGCTTCCTGGAGTG | 72* | 2376 |
| 1103736 | N/A | N/A | 5381 | 5400 | ACCTGCCAATCTCTGTTTCT | 94 | 2377 |
| 1103752 | N/A | N/A | 5447 | 5466 | GAATGCTCTCTTGTCTCTTT | 54 | 2378 |
| 1103768 | N/A | N/A | 5541 | 5560 | TGAGAGAAGCGGTACCAGGG | 79 | 2379 |
| 1103784 | N/A | N/A | 5832 | 5851 | AAAGTCAGTCACCTGGAGAG | 87 | 2380 |
| 1103800 | N/A | N/A | 5907 | 5926 | CAGTAATAATAATGGGTACT | 67 | 2381 |
| 1103816 | N/A | N/A | 5957 | 5976 | AGGGCTTAGAACAGAACAGT | 50 | 2382 |
| 1103832 | N/A | N/A | 6005 | 6024 | GTCAAAGAACAGCACCTACT | 121 | 2383 |
| 1103848 | N/A | N/A | 6160 | 6179 | GGTAGAGGCTCAGTAACCCA | 68 | 2384 |
| 1103864 | N/A | N/A | 6219 | 6238 | TCAATATCACACCTTCCAGG | 80 | 2385 |
| 1103880 | N/A | N/A | 6278 | 6297 | ACACTACATATAAGCTCTGA | 109 | 2386 |
| 1103896 | N/A | N/A | 6382 | 6401 | TCTGTCCTCCACTAGGAATG | 120 | 2387 |
| 1103912 | N/A | N/A | 6462 | 6481 | CACTCACACTCCTCAGCTAG | 85 | 2388 |
| 1103928 | N/A | N/A | 6554 | 6573 | CTGGGTTCTAATAGCCCTTT | 77 | 2389 |
| 1103944 | N/A | N/A | 6983 | 7002 | GCGAATGAATGAACAGTGCC | 75 | 2390 |
| 1103960 | N/A | N/A | 7122 | 7141 | TCAGGGAGGTGAGCAGCACC | 111 | 2391 |
| 1103976 | N/A | N/A | 7354 | 7373 | CGTCCCTGCTCCGCCCGTCC | 93 | 2392 |
| 1103992 | N/A | N/A | 7504 | 7523 | TCCCGCGGAGCCCCGACCCG | 90 | 2393 |
| 1104008 | N/A | N/A | 7857 | 7876 | GGAAGGGATCTGCACACAAG | 59 | 2394 |
| 1104024 | N/A | N/A | 7965 | 7984 | CCTTGAGGCCTAATCAATAT | 80 | 2395 |
| 1104040 | N/A | N/A | 8053 | 8072 | AGAAGAGATGGGTGAGGTGA | 85 | 2396 |
| 1104056 | N/A | N/A | 8201 | 8220 | TCTCCTAGCTTTTTCCCCAG | 131 | 2397 |
| 1104072 | N/A | N/A | 9327 | 9346 | CGTCACATTCACTAATATTT | 22 | 2398 |
| 1104088 | N/A | N/A | 9395 | 9414 | CCAATGCAAGTAAAAAGTAA | 92 | 2399 |

TABLE 32-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104104 | N/A | N/A | 9434 | 9453 | AAGAGGAATTTGTTCCTTA | 72 | 2400 |
| 1104120 | N/A | N/A | 9483 | 9502 | AGTCCTGAGACATGCATATC | 77 | 2401 |
| 1104136 | N/A | N/A | 9521 | 9540 | TACTAGTCAGCCTGGTTAGC | 69 | 2402 |
| 1104152 | N/A | N/A | 9550 | 9569 | GACTATCTAGGATTTGGCAG | 22 | 2403 |
| 1104168 | N/A | N/A | 9570 | 9589 | TCTGTGCTTTAGTGACCTGT | 56 | 2404 |
| 1104184 | N/A | N/A | 9637 | 9656 | TAGTGCTCAATACACATAGG | 58 | 2405 |
| 1104200 | N/A | N/A | 9681 | 9700 | AGACAATTAACTAAAATAAA | 85 | 2406 |
| 1104216 | N/A | N/A | 10132 | 10151 | GACTCCGTCGAAAGCAGGCA | 63 | 2407 |
| 1104232 | N/A | N/A | 10570 | 10589 | CTGAAAACCCAGCACGGTAT | 142 | 2408 |
| 1104248 | N/A | N/A | 10695 | 10714 | CTCTTCCAAACGGGCTGGAG | 69 | 2409 |
| 1104264 | N/A | N/A | 10791 | 10810 | GCATGAGCCATCCTCTCCCA | 121 | 2410 |
| 1104280 | N/A | N/A | 11024 | 11043 | GTTGCTGGGAACCTTCTATG | 34 | 2411 |
| 1104296 | N/A | N/A | 11122 | 11141 | CAAGGCTCCCCTTAGAACAG | 56 | 2412 |
| 1104312 | N/A | N/A | 11162 | 11181 | AGAGAGTGTGTATTAGGATC | 37 | 2413 |
| 1104328 | N/A | N/A | 11243 | 11262 | AGAGTTGGAAGTGAAAGCTA | 73 | 2414 |
| 1104344 | N/A | N/A | 11370 | 11389 | AGATGAGCTCCCACTGTGGT | 74 | 2415 |
| 1104360 | N/A | N/A | 11432 | 11451 | GGTGAGATAACACTGGGAAA | 48 | 2416 |
| 1104376 | N/A | N/A | 11553 | 11572 | GTTCACACAGACCCCAGGTC | 96 | 2417 |

TABLE 33

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 5 | 517 |
| 1103161 | 222 | 241 | 3670 | 3689 | TGAGTGCCCCAGCCAGGGAG | 168 | 2418 |
| 1103177 | 443 | 462 | 3891 | 3910 | GGCGGTGAGTTGATCGAGCC | 101 | 2419 |
| 1103193 | 654 | 673 | 5243 | 5262 | TCTTCCTCAAGAACCGGATC | 68 | 2420 |
| 1103209 | 948 | 967 | 7305 | 7324 | CGCGCAGAGACTCCAGGTCG | 112 | 2421 |
| 1103225 | 1295 | 1314 | 10909 | 10928 | CCGCATCTCCACGGTCTTCA | 74 | 2422 |
| 1103241 | 1409 | 1428 | 11698 | 11717 | ACTATCCTGCTTCTGCTCGG | 41 | 2423 |
| 1103257 | 1578 | 1597 | 11867 | 11886 | TGAGTTTCTTGTTAGTTGGA | 24 | 2424 |
| 1103273 | 1702 | 1721 | 11991 | 12010 | ACAACAGGAATCAGGGATGT | 94 | 2425 |
| 1103289 | 1840 | 1859 | 12129 | 12148 | CTGGCCAGGGCTACCTTGTC | 95 | 2426 |
| 1103305 | 1879 | 1898 | 12168 | 12187 | ATATCCCACCTCATAAAAAC | 108 | 2427 |

TABLE 33-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103321 | 2013 | 2032 | 12302 | 12321 | TCAGGGTCAGTCTAGGAGAA | 63 | 2428 |
| 1103337 | 2189 | 2208 | 12478 | 12497 | ATCCCCCAAGTGCTGAGAAT | 96 | 2429 |
| 1103353 | 2403 | 2422 | 12692 | 12711 | CACAATCCAGAGGCCAAGTG | 70 | 2430 |
| 1103369 | 2453 | 2472 | 12742 | 12761 | TTCTCTCCTGTTTCAGCATC | 32 | 2431 |
| 1103385 | 2497 | 2516 | 12786 | 12805 | GAAATGGGACAAAGTCATGC | 79 | 2432 |
| 1103401 | 2638 | 2657 | 12927 | 12946 | GGCTTAGGGAAAAGCAGCCG | 140 | 2433 |
| 1103417 | 2705 | 2724 | 12994 | 13013 | ATAGGGCACTACCTAGAATA | 117 | 2434 |
| 1103433 | 2792 | 2811 | 13081 | 13100 | TGTCAGCCCTGAGCACCCGG | 64 | 2435 |
| 1103449 | 3031 | 3050 | 13320 | 13339 | AGCGACTAAAGGCAGCAGCA | 64 | 2436 |
| 1103465 | N/A | N/A | 8753 | 8772 | GTGATTTTCCCCGTCTTTGG | 26 | 2437 |
| 1103481 | N/A | N/A | 8892 | 8911 | ACTCCCTGTCAAGCTGGGCA | 110 | 2438 |
| 1103497 | N/A | N/A | 8991 | 9010 | CACTGCAGTTCCTGGGAAAA | 92 | 2439 |
| 1103513 | N/A | N/A | 9170 | 9189 | TCCAGGCACAGCGAGACCCA | 121 | 2440 |
| 1103529 | N/A | N/A | 9251 | 9270 | GGAAGAATCCTCTGAACTGA | 86 | 2441 |
| 1103545 | N/A | N/A | 9296 | 9315 | CAGGGAACATAAAACTTTAT | 135 | 2442 |
| 1103561 | N/A | N/A | 8409 | 8428 | CAGGACTCCAGTGCCCTTCC | 97 | 2443 |
| 1103577 | N/A | N/A | 8548 | 8567 | CCCACCTAGAAGTACCCTGG | 72 | 2444 |
| 1103593 | N/A | N/A | 8736 | 8755 | TGGTGCTTTTGCCCCCTGTA | 84 | 2445 |
| 1103609 | N/A | N/A | 4044 | 4063 | GGCCCCTCCCTGAGACTTCT | 161 | 2446 |
| 1103625 | N/A | N/A | 4218 | 4237 | CTGCACTGCTTTCCCCAGTA | 123 | 2447 |
| 1103641 | N/A | N/A | 4381 | 4400 | CTTTCCCTCACTTTCTTCAC | 135 | 2448 |
| 1103657 | N/A | N/A | 4479 | 4498 | GACCACCGCTTCACAGCTGT | 118 | 2449 |
| 1103673 | N/A | N/A | 4594 | 4613 | CATGTCCTCCTGCACTTGAA | 66 | 2450 |
| 1103689 | N/A | N/A | 4745 | 4764 | ACAGAGGACTTGTCTGGAGG | 77 | 2451 |
| 1103705 | N/A | N/A | 4963 | 4982 | CTCCCTGACCTGTCTATAGG | 97* | 2452 |
| 1103721 | N/A | N/A | 5171 | 5190 | CTTCATCTGCTTCCTGGAGT | 78* | 2453 |
| 1103737 | N/A | N/A | 5382 | 5401 | TACCTGCCAATCTCTGTTTC | 79 | 2454 |
| 1103753 | N/A | N/A | 5449 | 5468 | TCGAATGCTCTCTTGTCTCT | 92 | 2455 |
| 1103769 | N/A | N/A | 5543 | 5562 | GGTGAGAGAAGCGGTACCAG | 141 | 2456 |
| 1103785 | N/A | N/A | 5834 | 5853 | TGAAAGTCAGTCACCTGGAG | 102 | 2457 |
| 1103801 | N/A | N/A | 5908 | 5927 | GCAGTAATAATAATGGGTAC | 69 | 2458 |
| 1103817 | N/A | N/A | 5958 | 5977 | CAGGGCTTAGAACAGAACAG | 61 | 2459 |
| 1103833 | N/A | N/A | 6014 | 6033 | CTCTCATCTGTCAAAGAACA | 87 | 2460 |
| 1103849 | N/A | N/A | 6161 | 6180 | TGGTAGAGGCTCAGTAACCC | 60 | 2461 |
| 1103865 | N/A | N/A | 6246 | 6265 | TCTACGGGCACTATGTTTGG | 79 | 2462 |
| 1103881 | N/A | N/A | 6279 | 6298 | CACACTACATATAAGCTCTG | 188 | 2463 |

TABLE 33-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103897 | N/A | N/A | 6398 | 6417 | TTTTCTGCCTCCAGGCTCTG | 93 | 2464 |
| 1103913 | N/A | N/A | 6469 | 6488 | CTTCTGCCACTCACACTCCT | 101 | 2465 |
| 1103929 | N/A | N/A | 6806 | 6825 | GTCAGTGGCACAATCCCGGG | 76 | 2466 |
| 1103945 | N/A | N/A | 6987 | 7006 | GCAAGCGAATGAATGAACAG | 76 | 2467 |
| 1103961 | N/A | N/A | 7123 | 7142 | ATCAGGGAGGTGAGCAGCAC | 51 | 2468 |
| 1103977 | N/A | N/A | 7360 | 7379 | GGTGGCCGTCCCTGCTCCGC | 89 | 2469 |
| 1103993 | N/A | N/A | 7760 | 7779 | TGATGAGGGCTCACCGGTTC | 77 | 2470 |
| 1104009 | N/A | N/A | 7896 | 7915 | GCTATGTGTGAGGCAGGCAC | 138 | 2471 |
| 1104025 | N/A | N/A | 7979 | 7998 | ACCCAAGTCCTTGGCCTTGA | 79 | 2472 |
| 1104041 | N/A | N/A | 8054 | 8073 | CAGAAGAGATGGGTGAGGTG | 71 | 2473 |
| 1104057 | N/A | N/A | 8202 | 8221 | ATCTCCTAGCTTTTTCCCCA | 147 | 2474 |
| 1104073 | N/A | N/A | 9345 | 9364 | AGAGAGAAAAATATAACACG | 90 | 2475 |
| 1104089 | N/A | N/A | 9401 | 9420 | TCAGGGCCAATGCAAGTAAA | 53 | 2476 |
| 1104105 | N/A | N/A | 9436 | 9455 | AGAAGAGGAATTTTGTTCCT | 68 | 2477 |
| 1104121 | N/A | N/A | 9484 | 9503 | AAGTCCTGAGACATGCATAT | 64 | 2478 |
| 1104137 | N/A | N/A | 9522 | 9541 | CTACTAGTCAGCCTGGTTAG | 68 | 2479 |
| 1104153 | N/A | N/A | 9551 | 9570 | TGACTATCTAGGATTTGGCA | 38 | 2480 |
| 1104169 | N/A | N/A | 9571 | 9590 | ATCTGTGCTTTAGTGACCTG | 80 | 2481 |
| 1104185 | N/A | N/A | 9638 | 9657 | TTAGTGCTCAATACACATAG | 75 | 2482 |
| 1104201 | N/A | N/A | 9682 | 9701 | GAGACAATTAACTAAAATAA | 86 | 2483 |
| 1104217 | N/A | N/A | 10133 | 10152 | AGACTCCGTCGAAAGCAGGC | 78 | 2484 |
| 1104233 | N/A | N/A | 10571 | 10590 | TCTGAAAACCCAGCACGGTA | 116 | 2485 |
| 1104249 | N/A | N/A | 10696 | 10715 | GCTCTTCCAAACGGGCTGGA | 116 | 2486 |
| 1104265 | N/A | N/A | 10795 | 10814 | CAGGGCATGAGCCATCCTCT | 101 | 2487 |
| 1104281 | N/A | N/A | 11056 | 11075 | CTCCTCCAGAATTCCCTGGG | 140 | 2488 |
| 1104297 | N/A | N/A | 11130 | 11149 | TTTGGTACCAAGGCTCCCCT | 72 | 2489 |
| 1104313 | N/A | N/A | 11178 | 11197 | TTTGAGGGTGAGAAAGAGAG | 82 | 2490 |
| 1104329 | N/A | N/A | 11259 | 11278 | CCCAACTGTGTCTGCTAGAG | 47 | 2491 |
| 1104345 | N/A | N/A | 11371 | 11390 | AAGATGAGCTCCCACTGTGG | 111 | 2492 |
| 1104361 | N/A | N/A | 11434 | 11453 | GTGGTGAGATAACACTGGGA | 43 | 2493 |
| 1104377 | N/A | N/A | 11557 | 11576 | AGGAGTTCACACAGACCCCA | 92 | 2494 |

TABLE 34

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTCCTCAGCG | 6 | 517 |
| 1103162 | 224 | 243 | 3672 | 3691 | ATTGAGTGCCCCAGCCAGGG | 94 | 2495 |
| 1103178 | 468 | 487 | 3916 | 3935 | TCTCAACCTCCAGCCGGGCG | 23* | 2496 |
| 1103194 | 687 | 706 | 5573 | 5592 | GCTCCTGGAGTTCCCGAACC | 139 | 2497 |
| 1103210 | 949 | 968 | 7306 | 7325 | CCGCGCAGAGACTCCAGGTC | 98 | 2498 |
| 1103226 | 1316 | 1335 | N/A | N/A | CTCCTTAATGACCTCTCCAT | 95 | 2499 |
| 1103242 | 1419 | 1438 | 11708 | 11727 | AGGCGGAGCAACTATCCTGC | 150 | 2500 |
| 1103258 | 1579 | 1598 | 11868 | 11887 | GTGAGTTTCTTGTTAGTTGG | 35 | 2501 |
| 1103274 | 1706 | 1725 | 11995 | 12014 | CATAACAACAGGAATCAGGG | 49 | 2502 |
| 1103290 | 1846 | 1865 | 12135 | 12154 | AAGCCTCTGGCCAGGGCTAC | 113 | 2503 |
| 1103306 | 1880 | 1899 | 12169 | 12188 | GATATCCCACCTCATAAAAA | 98 | 2504 |
| 1103322 | 2015 | 2034 | 12304 | 12323 | GATCAGGGTCAGTCTAGGAG | 46 | 2505 |
| 1103338 | 2196 | 2215 | 12485 | 12504 | ACAACAGATCCCCCAAGTGC | 89 | 2506 |
| 1103354 | 2405 | 2424 | 12694 | 12713 | CCCACAATCCAGAGGCCAAG | 79 | 2507 |
| 1103370 | 2454 | 2473 | 12743 | 12762 | TTTCTCTCCTGTTTCAGCAT | 31 | 2508 |
| 1103386 | 2498 | 2517 | 12787 | 12806 | AGAAATGGGACAAAGTCATG | 102 | 2509 |
| 1103402 | 2643 | 2662 | 12932 | 12951 | CCCTTGGCTTAGGGAAAAGC | 102 | 2510 |
| 1103418 | 2706 | 2725 | 12995 | 13014 | AATAGGGCACTACCTAGAAT | 130 | 2511 |
| 1103434 | 2793 | 2812 | 13082 | 13101 | GTGTCAGCCCTGAGCACCCG | 73 | 2512 |
| 1103450 | 3032 | 3051 | 13321 | 13340 | CAGCGACTAAAGGCAGCAGC | 76 | 2513 |
| 1103466 | N/A | N/A | 8759 | 8778 | GACCTTGTGATTTTCCCCGT | 55 | 2514 |
| 1103482 | N/A | N/A | 8893 | 8912 | CACTCCCTGTCAAGCTGGGC | 112 | 2515 |
| 1103498 | N/A | N/A | 9028 | 9047 | TAATGTACAGTTACTCTGTA | 80 | 2516 |
| 1103514 | N/A | N/A | 9206 | 9225 | CCTCAGGGATGAAAGAATAA | 56 | 2517 |
| 1103530 | N/A | N/A | 9252 | 9271 | GGGAAGAATCCTCTGAACTG | 83 | 2518 |
| 1103546 | N/A | N/A | 9297 | 9316 | GCAGGGAACATAAAACTTTA | 132 | 2519 |
| 1103562 | N/A | N/A | 8441 | 8460 | CTGGAGCAACCTACAGGCCC | 103 | 2520 |
| 1103578 | N/A | N/A | 8550 | 8569 | GCCCCACCTAGAAGTACCCT | 83 | 2521 |
| 1103594 | N/A | N/A | 8738 | 8757 | TTTGGTGCTTTTGCCCCCTG | 76 | 2522 |
| 1103610 | N/A | N/A | 4045 | 4064 | CGGCCCCTCCCTGAGACTTC | 92 | 2523 |
| 1103626 | N/A | N/A | 4219 | 4238 | CCTGCACTGCTTTCCCCAGT | 124 | 2524 |
| 1103642 | N/A | N/A | 4384 | 4403 | GCTCTTTCCCTCACTTTCTT | 111 | 2525 |
| 1103658 | N/A | N/A | 4480 | 4499 | TGACCACCGCTTCACAGCTG | 66 | 2526 |
| 1103674 | N/A | N/A | 4598 | 4617 | CGCACATGTCCTCCTGCACT | 122 | 2527 |
| 1103690 | N/A | N/A | 4746 | 4765 | GACAGAGGACTTGTCTGGAG | 69 | 2528 |
| 1103706 | N/A | N/A | 4966 | 4985 | CACCTCCCTGACCTGTCTAT | 165* | 2529 |

TABLE 34-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103722 | N/A | N/A | 5173 | 5192 | GGCTTCATCTGCTTCCTGGA | 11* | 2530 |
| 1103738 | N/A | N/A | 5390 | 5409 | CCTGTCTCTACCTGCCAATC | 93 | 2531 |
| 1103754 | N/A | N/A | 5456 | 5475 | CAGGAGTTCGAATGCTCTCT | 77 | 2532 |
| 1103770 | N/A | N/A | 5555 | 5574 | CCTCCTGACCAGGGTGAGAG | 91 | 2533 |
| 1103786 | N/A | N/A | 5838 | 5857 | CTGGTGAAAGTCAGTCACCT | 84 | 2534 |
| 1103802 | N/A | N/A | 5909 | 5928 | AGCAGTAATAATAATGGGTA | 122 | 2535 |
| 1103818 | N/A | N/A | 5960 | 5979 | CACAGGGCTTAGAACAGAAC | 101 | 2536 |
| 1103834 | N/A | N/A | 6015 | 6034 | TCTCTCATCTGTCAAAGAAC | 81 | 2537 |
| 1103850 | N/A | N/A | 6162 | 6181 | ATGGTAGAGGCTCAGTAACC | 66 | 2538 |
| 1103866 | N/A | N/A | 6247 | 6266 | CTCTACGGGCACTATGTTTG | 72 | 2539 |
| 1103882 | N/A | N/A | 6286 | 6305 | TGGCTCCCACACTACATATA | 89 | 2540 |
| 1103898 | N/A | N/A | 6401 | 6420 | TGCTTTTCTGCCTCCAGGCT | 82 | 2541 |
| 1103914 | N/A | N/A | 6476 | 6495 | CCAGTGGCTTCTGCCACTCA | 92 | 2542 |
| 1103930 | N/A | N/A | 6898 | 6917 | AGCGGAGGCCTGGGTGTTTT | 74 | 2543 |
| 1103946 | N/A | N/A | 6988 | 7007 | AGCAAGCGAATGAATGAACA | 116 | 2544 |
| 1103962 | N/A | N/A | 7124 | 7143 | AATCAGGGAGGTGAGCAGCA | 71 | 2545 |
| 1103978 | N/A | N/A | 7384 | 7403 | CCCTTCTCCCCTGGCATCTC | 130 | 2546 |
| 1103994 | N/A | N/A | 7792 | 7811 | GTGAGGCAGCAGGGAGACTT | 80 | 2547 |
| 1104010 | N/A | N/A | 7904 | 7923 | GACTGCCTGCTATGTGTGAG | 118 | 2548 |
| 1104026 | N/A | N/A | 7981 | 8000 | TGACCCAAGTCCTTGGCCTT | 109 | 2549 |
| 1104042 | N/A | N/A | 8056 | 8075 | GGCAGAAGAGATGGGTGAGG | 75 | 2550 |
| 1104058 | N/A | N/A | 8207 | 8226 | ACTCCATCTCCTAGCTTTTT | 95 | 2551 |
| 1104074 | N/A | N/A | 9347 | 9366 | CGAGAGAGAAAAATATAACA | 129 | 2552 |
| 1104090 | N/A | N/A | 9403 | 9422 | TTTCAGGGCCAATGCAAGTA | 49 | 2553 |
| 1104106 | N/A | N/A | 9447 | 9466 | TCTAGTCCAGAAGAAGAGGA | 76 | 2554 |
| 1104122 | N/A | N/A | 9494 | 9513 | ATGCTGAATTAAGTCCTGAG | 38 | 2555 |
| 1104138 | N/A | N/A | 9523 | 9542 | TCTACTAGTCAGCCTGGTTA | 68 | 2556 |
| 1104154 | N/A | N/A | 9553 | 9572 | TGTGACTATCTAGGATTTGG | 68 | 2557 |
| 1104170 | N/A | N/A | 9572 | 9591 | TATCTGTGCTTTAGTGACCT | 53 | 2558 |
| 1104186 | N/A | N/A | 9639 | 9658 | ATTAGTGCTCAATACACATA | 101 | 2559 |
| 1104202 | N/A | N/A | 9683 | 9702 | GGAGACAATTAACTAAAATA | 94 | 2560 |
| 1104218 | N/A | N/A | 10135 | 10154 | TAAGACTCCGTCGAAAGCAG | 131 | 2561 |
| 1104234 | N/A | N/A | 10572 | 10591 | TTCTGAAAACCCAGCACGGT | 110 | 2562 |
| 1104250 | N/A | N/A | 10708 | 10727 | GAGAGAGCCTAGGCTCTTCC | 70 | 2563 |
| 1104266 | N/A | N/A | 10796 | 10815 | TCAGGGCATGAGCCATCCTC | 60 | 2564 |
| 1104282 | N/A | N/A | 11065 | 11084 | TTCCTTGCTCTCCTCCAGAA | 156 | 2565 |

TABLE 34-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104298 | N/A | N/A | 11144 | 11163 | TCCCATCTAGTGGCTTTGGT | 48 | 2566 |
| 1104314 | N/A | N/A | 11212 | 11231 | TCTCTTTCTCTCCCTGGCAA | 74 | 2567 |
| 1104330 | N/A | N/A | 11264 | 11283 | CCATCCCCAACTGTGTCTGC | 64 | 2568 |
| 1104346 | N/A | N/A | 11381 | 11400 | CTGCTGGAGTAAGATGAGCT | 99 | 2569 |
| 1104362 | N/A | N/A | 11478 | 11497 | TTCTTGATAGTAACCACAGC | 53 | 2570 |
| 1104378 | N/A | N/A | 11558 | 11577 | TAGGAGTTCACACAGACCCC | 164 | 2571 |

TABLE 35

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1103163 | 233 | 252 | 3681 | 3700 | GAAGCCAGCATTGAGTGCCC | 109 | 2572 |
| 1103179 | 484 | 503 | 3932 | 3951 | TGTGCCAGATTGTCCCTCTC | 13* | 2573 |
| 1103195 | 713 | 732 | 5599 | 5618 | CACATGGACCTGCTGTCGGG | 107 | 2574 |
| 1103211 | 951 | 970 | 7308 | 7327 | TGCCGCGCAGAGACTCCAGG | 90 | 2575 |
| 1103227 | 1317 | 1336 | N/A | N/A | ACTCCTTAATGACCTCTCCA | 151 | 2576 |
| 1103243 | 1434 | 1453 | 11723 | 11742 | GAAATGTGCCAGCAGAGGCG | 96 | 2577 |
| 1103259 | 1581 | 1600 | 11870 | 11889 | GGGTGAGTTTCTTGTTAGTT | 15 | 2578 |
| 1103275 | 1712 | 1731 | 12001 | 12020 | AGTTTCCATAACAACAGGAA | 91 | 2579 |
| 1103291 | 1851 | 1870 | 12140 | 12159 | AAAACAAGCCTCTGGCCAGG | 115 | 2580 |
| 1103307 | 1881 | 1900 | 12170 | 12189 | GGATATCCCACCTCATAAAA | 107 | 2581 |
| 1103323 | 2030 | 2049 | 12319 | 12338 | CACCCATCTTAGACTGATCA | 116 | 2582 |
| 1103339 | 2197 | 2216 | 12486 | 12505 | CACAACAGATCCCCCAAGTG | 110 | 2583 |
| 1103355 | 2409 | 2428 | 12698 | 12717 | AATTCCCACAATCCAGAGGC | 72 | 2584 |
| 1103371 | 2455 | 2474 | 12744 | 12763 | CTTTCTCTCCTGTTTCAGCA | 20 | 2585 |
| 1103387 | 2506 | 2525 | 12795 | 12814 | AGGCCTTTAGAAATGGGACA | 76 | 2586 |
| 1103403 | 2656 | 2675 | 12945 | 12964 | GGACCGCAAGAGGCCCTTGG | 83 | 2587 |
| 1103419 | 2707 | 2726 | 12996 | 13015 | AAATAGGGCACTACCTAGAA | 100 | 2588 |
| 1103435 | 2831 | 2850 | 13120 | 13139 | CTGCTCAGTCAAAGCAGAGT | 99 | 2589 |
| 1103467 | N/A | N/A | 8765 | 8784 | TCTTGTGACCTTGTGATTTT | 55 | 2590 |
| 1103483 | N/A | N/A | 8894 | 8913 | TCACTCCCTGTCAAGCTGGG | 130 | 2591 |
| 1103499 | N/A | N/A | 9029 | 9048 | TTAATGTACAGTTACTCTGT | 98 | 2592 |
| 1103515 | N/A | N/A | 9214 | 9233 | CGATGGAGCCTCAGGGATGA | 57 | 2593 |
| 1103531 | N/A | N/A | 9253 | 9272 | AGGGAAGAATCCTCTGAACT | 59 | 2594 |

TABLE 35-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103547 | N/A | N/A | 9298 | 9317 | AGCAGGGAACATAAAACTTT | 79 | 2595 |
| 1103563 | N/A | N/A | 8458 | 8477 | TGATCCTCAGTCCCAGTCTG | 95 | 2596 |
| 1103579 | N/A | N/A | 8552 | 8571 | AAGCCCCACCTAGAAGTACC | 131 | 2597 |
| 1103595 | N/A | N/A | 3965 | 3984 | CCTCCTCACTTCTGCCTCAC | 77* | 2598 |
| 1103611 | N/A | N/A | 4046 | 4065 | TCGGCCCCTCCCTGAGACTT | 74 | 2599 |
| 1103627 | N/A | N/A | 4220 | 4239 | TCCTGCACTGCTTTCCCCAG | 80 | 2600 |
| 1103643 | N/A | N/A | 4385 | 4404 | TGCTCTTTCCCTCACTTTCT | 119 | 2601 |
| 1103659 | N/A | N/A | 4484 | 4503 | ATTATGACCACCGCTTCACA | 54 | 2602 |
| 1103675 | N/A | N/A | 4603 | 4622 | ACACACGCACATGTCCTCCT | 157 | 2603 |
| 1103691 | N/A | N/A | 4751 | 4770 | CCTTAGACAGAGGACTTGTC | 90 | 2604 |
| 1103707 | N/A | N/A | 4967 | 4986 | CCACCTCCCTGACCTGTCTA | 102* | 2605 |
| 1103723 | N/A | N/A | 5301 | 5320 | AGTTGCAATCTCTGTGTTGA | 105 | 2606 |
| 1103739 | N/A | N/A | 5391 | 5410 | TCCTGTCTCTACCTGCCAAT | 81 | 2607 |
| 1103755 | N/A | N/A | 5457 | 5476 | CCAGGAGTTCGAATGCTCTC | 97 | 2608 |
| 1103771 | N/A | N/A | 5557 | 5576 | AACCTCCTGACCAGGGTGAG | 87 | 2609 |
| 1103787 | N/A | N/A | 5839 | 5858 | TCTGGTGAAAGTCAGTCACC | 99 | 2610 |
| 1103803 | N/A | N/A | 5910 | 5929 | TAGCAGTAATAATAATGGGT | 53 | 2611 |
| 1103819 | N/A | N/A | 5967 | 5986 | TGAAAAGCACAGGGCTTAGA | 118 | 2612 |
| 1103835 | N/A | N/A | 6016 | 6035 | CTCTCTCATCTGTCAAAGAA | 64 | 2613 |
| 1103851 | N/A | N/A | 6164 | 6183 | ATATGGTAGAGGCTCAGTAA | 70 | 2614 |
| 1103867 | N/A | N/A | 6253 | 6272 | GGTGTTCTCTACGGGCACTA | 87 | 2615 |
| 1103883 | N/A | N/A | 6289 | 6308 | TCCTGGCTCCCACACTACAT | 109 | 2616 |
| 1103899 | N/A | N/A | 6402 | 6421 | GTGCTTTTCTGCCTCCAGGC | 32 | 2617 |
| 1103915 | N/A | N/A | 6489 | 6508 | CCCTGCTCAGACACCAGTGG | 157 | 2618 |
| 1103931 | N/A | N/A | 6899 | 6918 | GAGCGGAGGCCTGGGTGTTT | 123 | 2619 |
| 1103947 | N/A | N/A | 7005 | 7024 | TAGCACAACACCTGGTCAGC | 92 | 2620 |
| 1103963 | N/A | N/A | 7127 | 7146 | GGAAATCAGGGAGGTGAGCA | 58 | 2621 |
| 1103979 | N/A | N/A | 7385 | 7404 | GCCCTTCTCCCCTGGCATCT | 83 | 2622 |
| 1103995 | N/A | N/A | 7799 | 7818 | CTCTACCGTGAGGCAGCAGG | 97 | 2623 |
| 1104011 | N/A | N/A | 7909 | 7928 | CTAGTGACTGCCTGCTATGT | 112 | 2624 |
| 1104027 | N/A | N/A | 8007 | 8026 | GGGAGTATGCCTCTTAGTTT | 55 | 2625 |
| 1104043 | N/A | N/A | 8071 | 8090 | AGAAAGTTCCAAGGAGGCAG | 112 | 2626 |
| 1104059 | N/A | N/A | 8208 | 8227 | AACTCCATCTCCTAGCTTTT | 85 | 2627 |
| 1104075 | N/A | N/A | 9348 | 9367 | CCGAGAGAGAAAAATATAAC | 66 | 2628 |
| 1104091 | N/A | N/A | 9404 | 9423 | ATTTCAGGGCCAATGCAAGT | 85 | 2629 |
| 1104107 | N/A | N/A | 9448 | 9467 | TTCTAGTCCAGAAGAAGAGG | 72 | 2630 |

TABLE 35-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104123 | N/A | N/A | 9495 | 9514 | GATGCTGAATTAAGTCCTGA | 41 | 2631 |
| 1104139 | N/A | N/A | 9527 | 9546 | TACCTCTACTAGTCAGCCTG | 78 | 2632 |
| 1104155 | N/A | N/A | 9554 | 9573 | CTGTGACTATCTAGGATTTG | 70 | 2633 |
| 1104171 | N/A | N/A | 9573 | 9592 | TTATCTGTGCTTTAGTGACC | 54 | 2634 |
| 1104187 | N/A | N/A | 9642 | 9661 | CATATTAGTGCTCAATACAC | 59 | 2635 |
| 1104203 | N/A | N/A | 9703 | 9722 | ACTTCTCTAGGTGGGAGAGA | 58 | 2636 |
| 1104219 | N/A | N/A | 10136 | 10155 | GTAAGACTCCGTCGAAAGCA | 99 | 2637 |
| 1104235 | N/A | N/A | 10573 | 10592 | TTTCTGAAAACCCAGCACGG | 132 | 2638 |
| 1104251 | N/A | N/A | 10730 | 10749 | TGAGAACCTATGCAACCGAG | 62 | 2639 |
| 1104267 | N/A | N/A | 10798 | 10817 | TTTCAGGGCATGAGCCATCC | 140 | 2640 |
| 1104283 | N/A | N/A | 11070 | 11089 | TCAGTTTCCTTGCTCTCCTC | 82 | 2641 |
| 1104299 | N/A | N/A | 11146 | 11165 | GATCCCATCTAGTGGCTTTG | 39 | 2642 |
| 1104315 | N/A | N/A | 11213 | 11232 | TTCTCTTTCTCTCCCTGGCA | 85 | 2643 |
| 1104331 | N/A | N/A | 11265 | 11284 | CCCATCCCCAACTGTGTCTG | 73 | 2644 |
| 1104347 | N/A | N/A | 11384 | 11403 | AAGCTGCTGGAGTAAGATGA | 122 | 2645 |
| 1104363 | N/A | N/A | 11483 | 11502 | TACTTTTCTTGATAGTAACC | 74 | 2646 |
| 1104379 | N/A | N/A | 11559 | 11578 | TTAGGAGTTCACACAGACCC | 85 | 2647 |

TABLE 36

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 10 | 517 |
| 1103164 | 254 | 273 | 3702 | 3721 | CTCACTGGCCCGGGTCTCCT | 133 | 2648 |
| 1103180 | 485 | 504 | 3933 | 3952 | CTGTGCCAGATTGTCCCTCT | 16* | 2649 |
| 1103196 | 714 | 733 | 5600 | 5619 | CCACATGGACCTGCTGTCGG | 121 | 2650 |
| 1103212 | 1046 | 1065 | 7618 | 7637 | TTCCTCCAGCCGCGCCAGCG | 135 | 2651 |
| 1103228 | 1324 | 1343 | 11613 | 11632 | TGCTTGGACTCCTTAATGAC | 97 | 2652 |
| 1103244 | 1436 | 1455 | 11725 | 11744 | GGGAAATGTGCCAGCAGAGG | 39 | 2653 |
| 1103260 | 1601 | 1620 | 11890 | 11909 | CCCTCCAGACTGCCCCTTGG | 95 | 2654 |
| 1103276 | 1726 | 1745 | 12015 | 12034 | CCATCTCTGGCAACAGTTTC | 71 | 2655 |
| 1103292 | 1856 | 1875 | 12145 | 12164 | AAGACAAAACAAGCCTCTGG | 88 | 2656 |
| 1103308 | 1882 | 1901 | 12171 | 12190 | GGGATATCCCACCTCATAAA | 88 | 2657 |
| 1103324 | 2031 | 2050 | 12320 | 12339 | CCACCCATCTTAGACTGATC | 100 | 2658 |

TABLE 36-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103340 | 2198 | 2217 | 12487 | 12506 | ACACAACAGATCCCCCAAGT | 90 | 2659 |
| 1103356 | 2410 | 2429 | 12699 | 12718 | TAATTCCCACAATCCAGAGG | 115 | 2660 |
| 1103372 | 2459 | 2478 | 12748 | 12767 | TCCCCTTTCTCTCCTGTTTC | 101 | 2661 |
| 1103388 | 2508 | 2527 | 12797 | 12816 | AGAGGCCTTTAGAAATGGGA | 102 | 2662 |
| 1103404 | 2662 | 2681 | 12951 | 12970 | AAGAAGGGACCGCAAGAGGC | 83 | 2663 |
| 1103420 | 2715 | 2734 | 13004 | 13023 | CAATTGTAAAATAGGGCACT | 115 | 2664 |
| 1103436 | 2835 | 2854 | 13124 | 13143 | CAGTCTGCTCAGTCAAAGCA | 121 | 2665 |
| 1103468 | N/A | N/A | 8766 | 8785 | ATCTTGTGACCTTGTGATTT | 75 | 2666 |
| 1103484 | N/A | N/A | 8895 | 8914 | CTCACTCCTGTCAAGCTGG | 98 | 2667 |
| 1103500 | N/A | N/A | 9033 | 9052 | CAGTTTAATGTACAGTTACT | 90 | 2668 |
| 1103516 | N/A | N/A | 9215 | 9234 | GCGATGGAGCCTCAGGGATG | 28 | 2669 |
| 1103532 | N/A | N/A | 9254 | 9273 | GAGGGAAGAATCCTCTGAAC | 86 | 2670 |
| 1103548 | N/A | N/A | 9305 | 9324 | CATTAAGAGCAGGGAACATA | 85 | 2671 |
| 1103564 | N/A | N/A | 8492 | 8511 | GAAGGCCCCAGGGAGAGCT | 72 | 2672 |
| 1103580 | N/A | N/A | 8553 | 8572 | CAAGCCCCACCTAGAAGTAC | 107 | 2673 |
| 1103596 | N/A | N/A | 3966 | 3985 | CCCTCCTCACTTCTGCCTCA | 98* | 2674 |
| 1103612 | N/A | N/A | 4047 | 4066 | TTCGGCCCCTCCCTGAGACT | 77 | 2675 |
| 1103628 | N/A | N/A | 4227 | 4246 | CCGCTGCTCCTGCACTGCTT | 123 | 2676 |
| 1103644 | N/A | N/A | 4387 | 4406 | CCTGCTCTTTCCCTCACTTT | 110 | 2677 |
| 1103660 | N/A | N/A | 4485 | 4504 | TATTATGACCACCGCTTCAC | 85 | 2678 |
| 1103676 | N/A | N/A | 4604 | 4623 | CACACACGCACATGTCCTCC | 106 | 2679 |
| 1103692 | N/A | N/A | 4754 | 4773 | GGGCCTTAGACAGAGGACTT | 97 | 2680 |
| 1103708 | N/A | N/A | 4970 | 4989 | CCTCCACCTCCCTGACCTGT | 91* | 2681 |
| 1103724 | N/A | N/A | 5302 | 5321 | CAGTTGCAATCTCTGTGTTG | 127 | 2682 |
| 1103740 | N/A | N/A | 5392 | 5411 | TTCCTGTCTCTACCTGCCAA | 153 | 2683 |
| 1103756 | N/A | N/A | 5475 | 5494 | CTTCTGCCTGCCCCTCGGCC | 109 | 2684 |
| 1103772 | N/A | N/A | 5558 | 5577 | GAACCTCCTGACCAGGGTGA | 116 | 2685 |
| 1103788 | N/A | N/A | 5840 | 5859 | CTCTGGTGAAAGTCAGTCAC | 112 | 2686 |
| 1103804 | N/A | N/A | 5911 | 5930 | GTAGCAGTAATAATAATGGG | 93 | 2687 |
| 1103820 | N/A | N/A | 5969 | 5988 | CATGAAAAGCACAGGGCTTA | 94 | 2688 |
| 1103836 | N/A | N/A | 6017 | 6036 | GCTCTCTCATCTGTCAAAGA | 59 | 2689 |
| 1103852 | N/A | N/A | 6197 | 6216 | AGACACCTCTCTGTGTCCTG | 60 | 2690 |
| 1103868 | N/A | N/A | 6255 | 6274 | GTGGTGTTCTCTACGGGCAC | 95 | 2691 |
| 1103884 | N/A | N/A | 6308 | 6327 | GCCCCCTCTACAGTGTCTTT | 85 | 2692 |
| 1103900 | N/A | N/A | 6405 | 6424 | TCTGTGCTTTTCTGCCTCCA | 59 | 2693 |
| 1103916 | N/A | N/A | 6493 | 6512 | CTCACCCTGCTCAGACACCA | 105 | 2694 |

TABLE 36-continued

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103932 | N/A | N/A | 6900 | 6919 | CGAGCGGAGGCCTGGGTGTT | 59 | 2695 |
| 1103948 | N/A | N/A | 7006 | 7025 | CTAGCACAACACCTGGTCAG | 106 | 2696 |
| 1103964 | N/A | N/A | 7195 | 7214 | AGGTCTGCAAACTAGGTGGG | 93 | 2697 |
| 1103980 | N/A | N/A | 7414 | 7433 | CCCGCCCTCGACCCAGGTCC | 121 | 2698 |
| 1103996 | N/A | N/A | 7802 | 7821 | GAGCTCTACCGTGAGGCAGC | 101 | 2699 |
| 1104012 | N/A | N/A | 7911 | 7930 | ATCTAGTGACTGCCTGCTAT | 95 | 2700 |
| 1104028 | N/A | N/A | 8031 | 8050 | AGTCCAATCTTGGCTGGGAA | 80 | 2701 |
| 1104044 | N/A | N/A | 8073 | 8092 | GAAGAAAGTTCCAAGGAGGC | 94 | 2702 |
| 1104060 | N/A | N/A | 8209 | 8228 | TAACTCCATCTCCTAGCTTT | 89 | 2703 |
| 1104076 | N/A | N/A | 9349 | 9368 | CCCGAGAGAGAAAATATAA | 99 | 2704 |
| 1104092 | N/A | N/A | 9406 | 9425 | TCATTTCAGGGCCAATGCAA | 63 | 2705 |
| 1104108 | N/A | N/A | 9450 | 9469 | TATTCTAGTCCAGAAGAAGA | 127 | 2706 |
| 1104124 | N/A | N/A | 9504 | 9523 | AGCCTTTCTGATGCTGAATT | 52 | 2707 |
| 1104140 | N/A | N/A | 9528 | 9547 | TTACCTCTACTAGTCAGCCT | 75 | 2708 |
| 1104156 | N/A | N/A | 9555 | 9574 | CCTGTGACTATCTAGGATTT | 52 | 2709 |
| 1104172 | N/A | N/A | 9574 | 9593 | TTTATCTGTGCTTTAGTGAC | 50 | 2710 |
| 1104188 | N/A | N/A | 9651 | 9670 | CATGTGGCACATATTAGTGC | 97 | 2711 |
| 1104204 | N/A | N/A | 9704 | 9723 | TACTTCTCTAGGTGGGAGAG | 83 | 2712 |
| 1104220 | N/A | N/A | 10137 | 10156 | AGTAAGACTCCGTCGAAAGC | 124 | 2713 |
| 1104236 | N/A | N/A | 10574 | 10593 | CTTTCTGAAAACCCAGCACG | 87 | 2714 |
| 1104252 | N/A | N/A | 10731 | 10750 | ATGAGAACCTATGCAACCGA | 68 | 2715 |
| 1104268 | N/A | N/A | 10807 | 10826 | CTCATGGACTTTCAGGGCAT | 84 | 2716 |
| 1104284 | N/A | N/A | 11076 | 11095 | TTACATTCAGTTTCCTTGCT | 108 | 2717 |
| 1104300 | N/A | N/A | 11147 | 11166 | GGATCCCATCTAGTGGCTTT | 94 | 2718 |
| 1104316 | N/A | N/A | 11222 | 11241 | TAACTTTAATTCTCTTTCTC | 135 | 2719 |
| 1104332 | N/A | N/A | 11266 | 11285 | CCCCATCCCCAACTGTGTCT | 80 | 2720 |
| 1104348 | N/A | N/A | 11385 | 11404 | TAAGCTGCTGGAGTAAGATG | 92 | 2721 |
| 1104364 | N/A | N/A | 11484 | 11503 | TTACTTTTCTTGATAGTAAC | 89 | 2722 |
| 1104380 | N/A | N/A | 11573 | 11592 | GCACAGTGCAACAGTTAGGA | 38 | 2723 |

TABLE 37

Reduction of GFAP RNA by 5-10-5 MOE gapmers with mixed
PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103165 | 261 | 280 | 3709 | 3728 | CTGCCCGCTCACTGGCCCGG | 98 | 2724 |
| 1103181 | 505 | 524 | 3953 | 3972 | TGCCTCACAGTGGCCAGGTC | 45* | 2725 |
| 1103197 | 756 | 775 | 5642 | 5661 | CTTTCAGGGCTGCGGTGAGG | 99 | 2726 |
| 1103213 | 1048 | 1067 | 7620 | 7639 | TCTTCCTCCAGCCGCGCCAG | 53 | 2727 |
| 1103229 | 1325 | 1344 | 11614 | 11633 | CTGCTTGGACTCCTTAATGA | 73 | 2728 |
| 1103245 | 1497 | 1516 | 11786 | 11805 | AAGCTGACCTAGGGACAGAG | 106 | 2729 |
| 1103261 | 1602 | 1621 | 11891 | 11910 | CCCCTCCAGACTGCCCCTTG | 73 | 2730 |
| 1103277 | 1727 | 1746 | 12016 | 12035 | TCCATCTCTGGCAACAGTTT | 48 | 2731 |
| 1103293 | 1857 | 1876 | 12146 | 12165 | AAAGACAAAACAAGCCTCTG | 71 | 2732 |
| 1103309 | 1883 | 1902 | 12172 | 12191 | AGGGATATCCCACCTCATAA | 159 | 2733 |
| 1103325 | 2057 | 2076 | 12346 | 12365 | TGACTGCCCCAGGTGGCAGG | 116 | 2734 |
| 1103341 | 2199 | 2218 | 12488 | 12507 | TACACAACAGATCCCCCAAG | 86 | 2735 |
| 1103357 | 2411 | 2430 | 12700 | 12719 | TTAATTCCCACAATCCAGAG | 104 | 2736 |
| 1103373 | 2460 | 2479 | 12749 | 12768 | ATCCCCTTTCTCTCCTGTTT | 76 | 2737 |
| 1103389 | 2509 | 2528 | 12798 | 12817 | AAGAGGCCTTTAGAAATGGG | 71 | 2738 |
| 1103405 | 2663 | 2682 | 12952 | 12971 | TAAGAAGGGACCGCAAGAGG | 81 | 2739 |
| 1103421 | 2716 | 2735 | 13005 | 13024 | ACAATTGTAAAATAGGGCAC | 81 | 2740 |
| 1103437 | 2837 | 2856 | 13126 | 13145 | ACCAGTCTGCTCAGTCAAAG | 90 | 2741 |
| 1103469 | N/A | N/A | 8767 | 8786 | TATCTTGTGACCTTGTGATT | 54 | 2742 |
| 1103485 | N/A | N/A | 8896 | 8915 | GCTCACTCCCTGTCAAGCTG | 76 | 2743 |
| 1103501 | N/A | N/A | 9042 | 9061 | AAGCTCTGCCAGTTTAATGT | 57 | 2744 |
| 1103517 | N/A | N/A | 9216 | 9235 | AGCGATGGAGCCTCAGGGAT | 83 | 2745 |
| 1103533 | N/A | N/A | 9255 | 9274 | TGAGGGAAGAATCCTCTGAA | 92 | 2746 |
| 1103549 | N/A | N/A | 9306 | 9325 | ACATTAAGAGCAGGGAACAT | 105 | 2747 |
| 1103565 | N/A | N/A | 8499 | 8518 | GTGTCACGAAGGCCCCCAGG | 72 | 2748 |
| 1103581 | N/A | N/A | 8556 | 8575 | CTGCAAGCCCCACCTAGAAG | 94 | 2749 |
| 1103597 | N/A | N/A | 3989 | 4008 | TCACAAGGCCCCCCTTCCCC | 98 | 2750 |
| 1103613 | N/A | N/A | 4048 | 4067 | GTTCGGCCCCTCCCTGAGAC | 90 | 2751 |
| 1103629 | N/A | N/A | 4228 | 4247 | CCCGCTGCTCCTGCACTGCT | 83 | 2752 |
| 1103645 | N/A | N/A | 4389 | 4408 | TGCCTGCTCTTTCCCTCACT | 88 | 2753 |
| 1103661 | N/A | N/A | 4489 | 4508 | ATTTTATTATGACCACCGCT | 97 | 2754 |
| 1103677 | N/A | N/A | 4625 | 4644 | TCACTGTTGCACACACACAC | 124 | 2755 |
| 1103693 | N/A | N/A | 4775 | 4794 | GCAGGAGGATTAAGGGTTGG | 76 | 2756 |
| 1103709 | N/A | N/A | 5010 | 5029 | TGGGTGGCCATCAATCCTTT | 97 | 2757 |
| 1103725 | N/A | N/A | 5303 | 5322 | TCAGTTGCAATCTCTGTGTT | 65 | 2758 |

TABLE 37-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103741 | N/A | N/A | 5394 | 5413 | ATTTCCTGTCTCTACCTGCC | 95 | 2759 |
| 1103757 | N/A | N/A | 5480 | 5499 | GTCCTCTTCTGCCTGCCCCT | 90 | 2760 |
| 1103773 | N/A | N/A | 5722 | 5741 | CAGGGCTACCTTGGAGCGGT | 71 | 2761 |
| 1103789 | N/A | N/A | 5848 | 5867 | TCTCACTTCTCTGGTGAAAG | 82 | 2762 |
| 1103805 | N/A | N/A | 5912 | 5931 | AGTAGCAGTAATAATAATGG | 86 | 2763 |
| 1103821 | N/A | N/A | 5973 | 5992 | AATCCATGAAAAGCACAGGG | 88 | 2764 |
| 1103837 | N/A | N/A | 6018 | 6037 | GGCTCTCTCATCTGTCAAAG | 24 | 2765 |
| 1103853 | N/A | N/A | 6198 | 6217 | CAGACACCTCTCTGTGTCCT | 108 | 2766 |
| 1103869 | N/A | N/A | 6256 | 6275 | TGTGGTGTTCTCTACGGGCA | 62 | 2767 |
| 1103885 | N/A | N/A | 6312 | 6331 | AAATGCCCCCTCTACAGTGT | 110 | 2768 |
| 1103901 | N/A | N/A | 6406 | 6425 | CTCTGTGCTTTTCTGCCTCC | 67 | 2769 |
| 1103917 | N/A | N/A | 6500 | 6519 | TCGGGCCCTCACCCTGCTCA | 92 | 2770 |
| 1103933 | N/A | N/A | 6902 | 6921 | GGCGAGCGGAGGCCTGGGTG | 12 | 2771 |
| 1103949 | N/A | N/A | 7016 | 7035 | ACCTCAGCACCTAGCACAAC | 90 | 2772 |
| 1103965 | N/A | N/A | 7197 | 7216 | TCAGGTCTGCAAACTAGGTG | 72 | 2773 |
| 1103981 | N/A | N/A | 7415 | 7434 | CCCCGCCCTCGACCCAGGTC | 131 | 2774 |
| 1103997 | N/A | N/A | 7804 | 7823 | ATGAGCTCTACCGTGAGGCA | 88 | 2775 |
| 1104013 | N/A | N/A | 7913 | 7932 | ACATCTAGTGACTGCCTGCT | 94 | 2776 |
| 1104029 | N/A | N/A | 8034 | 8053 | AGGAGTCCAATCTTGGCTGG | 74 | 2777 |
| 1104045 | N/A | N/A | 8074 | 8093 | TGAAGAAAGTTCCAAGGAGG | 95 | 2778 |
| 1104061 | N/A | N/A | 8215 | 8234 | AAAGTCTAACTCCATCTCCT | 131 | 2779 |
| 1104077 | N/A | N/A | 9358 | 9377 | CCCGCCCCGCCCGAGAGAGA | 83 | 2780 |
| 1104093 | N/A | N/A | 9408 | 9427 | AATCATTTCAGGGCCAATGC | 24 | 2781 |
| 1104109 | N/A | N/A | 9451 | 9470 | ATATTCTAGTCCAGAAGAAG | 123 | 2782 |
| 1104125 | N/A | N/A | 9505 | 9524 | TAGCCTTTCTGATGCTGAAT | 57 | 2783 |
| 1104141 | N/A | N/A | 9529 | 9548 | ATTACCTCTACTAGTCAGCC | 59 | 2784 |
| 1104157 | N/A | N/A | 9556 | 9575 | ACCTGTGACTATCTAGGATT | 82 | 2785 |
| 1104173 | N/A | N/A | 9575 | 9594 | ATTTATCTGTGCTTTAGTGA | 41 | 2786 |
| 1104189 | N/A | N/A | 9652 | 9671 | ACATGTGGCACATATTAGTG | 98 | 2787 |
| 1104205 | N/A | N/A | 9705 | 9724 | CTACTTCTCTAGGTGGGAGA | 79 | 2788 |
| 1104221 | N/A | N/A | 10138 | 10157 | GAGTAAGACTCCGTCGAAAG | 89 | 2789 |
| 1104237 | N/A | N/A | 10608 | 10627 | TCAGCCCCTCTGCAAGCCCT | 85 | 2790 |
| 1104253 | N/A | N/A | 10732 | 10751 | TATGAGAACCTATGCAACCG | 72 | 2791 |
| 1104269 | N/A | N/A | 10808 | 10827 | TCTCATGGACTTTCAGGGCA | 112 | 2792 |
| 1104285 | N/A | N/A | 11077 | 11096 | ATTACATTCAGTTTCCTTGC | 103 | 2793 |
| 1104301 | N/A | N/A | 11148 | 11167 | AGGATCCCATCTAGTGGCTT | 91 | 2794 |

TABLE 37-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104317 | N/A | N/A | 11224 | 11243 | ACTAACTTTAATTCTCTTTC | 96 | 2795 |
| 1104333 | N/A | N/A | 11274 | 11293 | AAAGCCCTCCCCATCCCCAA | 128 | 2796 |
| 1104349 | N/A | N/A | 11387 | 11406 | GGTAAGCTGCTGGAGTAAGA | 26 | 2797 |
| 1104365 | N/A | N/A | 11485 | 11504 | CTTACTTTTCTTGATAGTAA | 36 | 2798 |
| 1104381 | N/A | N/A | 11605 | 11624 | CTCCTTAATGACCTGCAGGG | 74 | 2799 |

TABLE 38

Reduction of GFAP RNA by 5-10-5 MOE gapmers with mixed PO/PS internucleoside linkages in U251 cells

| Compound Number | SEQ ID NO: 3 Start Site | SEQ ID NO: 3 Stop Site | Sequence (5' to 3) | GFAP (% UTC) | SEQ ID NO |
|---|---|---|---|---|---|
| 1103451 | 1220 | 1239 | CCCTCGAATCTGCAGGTTGG | 94 | 2800 |
| 1103452 | 1227 | 1246 | TTTTGCCCCCTCGAATCTGC | 106 | 2801 |
| 1103453 | 1228 | 1247 | CTTTTGCCCCCTCGAATCTG | 84 | 2802 |
| 1103454 | 1229 | 1248 | GCTTTTGCCCCCTCGAATCT | 95 | 2803 |
| 1103455 | 1231 | 1250 | GTGCTTTTGCCCCCTCGAAT | 59 | 2804 |
| 1103456 | 1233 | 1252 | TGGTGCTTTTGCCCCCTCGA | 92 | 2805 |
| 1103457 | 1235 | 1254 | TTTGGTGCTTTTGCCCCCTC | 60 | 2806 |
| 1103554 | 1813 | 1832 | TTAATATTTAACATTAAGAG | 77 | 2807 |
| 1047595 | 1222 | 1241 | CCCCCTCGAATCTGCAGGTT | 109 | 284 |
| 1047596 | 1223 | 1242 | GCCCCCTCGAATCTGCAGGT | 107 | 362 |
| 1047597 | 1225 | 1244 | TTGCCCCCTCGAATCTGCAG | 65 | 440 |
| 1047598 | 1230 | 1249 | TGCTTTTGCCCCCTCGAATC | 115 | 518 |
| 1047599 | 1232 | 1251 | GGTGCTTTTGCCCCCTCGAA | 43 | 596 |
| 1047600 | 1234 | 1253 | TTGGTGCTTTTGCCCCCTCG | 86 | 674 |

Example 3: Effect of Modified Oligonucleotides on Human GFAP RNA In Vitro, Multiple Doses Modified oligonucleotides selected from the examples above were tested at various doses in U251 cells. Cultured U251 cells at a density of 10,000 cells per well were treated using free uptake with various concentrations of modified oligonucleotide as specified in the tables below. After a treatment period of approximately 48 hours, total RNA was isolated from the cells and GFAP RNA levels were measured by quantitative real-time RTPCR. Human GFAP primer probe set RTS37485 was used to measure RNA levels, as described above. GFAP RNA levels were adjusted according to total RNA content, as measured by RIBOGREEN®. Results are presented as percent of GFAP RNA, relative to untreated control cells (% control). Where possible, the half maximal inhibitory concentration ($IC_{50}$) of each modified oligonucleotide was calculated using a linear regression on a log/linear plot of the data in Excel. In some cases, an $IC_{50}$ could not be reliably calculated and the data point is marked as "NC". Modified oligonucleotides marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 39

Dose-dependent percent of human GFAP RNA compared to untreated control in U251 cells by modified oligonucleotides

| | GFAP RNA (% control) | | | | $IC_{50}$ |
|---|---|---|---|---|---|
| Compound No. | 125 nM | 500 nM | 2000 nM | 8000 nM | (µM) |
| 1047225 | 76 | 57 | 47 | 42 | 2.0 |
| 1047257 | 60 | 51 | 39 | 33 | 0.5 |
| 1047258 | 51 | 50 | 38 | 29 | 0.2 |
| 1047386 | 99 | 82 | 41 | 26 | 1.9 |
| 1047387 | 109 | 73 | 33 | 13 | 1.3 |
| 1047448 | 85 | 122 | 99 | 94 | NC |
| 1047466 | 107 | 82 | 77 | 46 | 7.8 |
| 1047497 | 120 | 117 | 107 | 136 | NC |
| 1047512 | 116 | 112 | 97 | 87 | NC |
| 1047584 | 94 | 54 | 23 | 10 | 0.8 |
| 1047608 | 125 | 133 | 79 | 52 | NC |
| 1047609 | 88 | 82 | 57 | 33 | 3.0 |
| 1047610 | 92 | 75 | 43 | 19 | 1.5 |
| 1047913 | 98 | 72 | 49 | 25 | 1.9 |
| 1048203 | 120 | 95 | 57 | 31 | 3.3 |
| 1048267 | 99 | 100 | 93 | 70 | NC |
| 1048296 | 99 | 91 | 73 | 72 | NC |
| 1048344 | 77 | 97 | 88 | 86 | NC |
| 1048361 | 92 | 115 | 85 | 109 | NC |

TABLE 40

Dose-dependent percent of human GFAP RNA compared to untreated control in U251 cells by modified oligonucleotides

| | GFAP RNA (% control) | | | | $IC_{50}$ |
|---|---|---|---|---|---|
| Compound No. | 125 nM | 500 nM | 2000 nM | 8000 nM | (µM) |
| 1047325 | 81 | 86 | 76 | 67 | NC |
| 1047357 | 74 | 63 | 47 | 22 | 1.1 |
| 1047372 | 145 | 143 | 125 | 99 | NC |
| 1047373 | 105 | 73 | 43 | 21 | 1.7 |
| 1047374 | 150 | 122 | 84 | 46 | 7.3 |
| 1047388 | 108 | 116 | 62 | 32 | 4.2 |

TABLE 40-continued

Dose-dependent percent of human GFAP RNA compared to untreated control in U251 cells by modified oligonucleotides

| Compound No. | GFAP RNA (% control) | | | | IC$_{50}$ (µM) |
|---|---|---|---|---|---|
| | 125 nM | 500 nM | 2000 nM | 8000 nM | |
| 1047500 | 100 | 105 | 74 | 60 | NC |
| 1047515 | 93 | 95 | 81 | 65 | NC |
| 1047518 | 125 | 99 | 81 | 51 | NC |
| 1047579 | 92 | 113 | 81 | 53 | NC |
| 1047580 | 96 | 88 | 58 | 41 | 4.3 |
| 1047581 | 73 | 60 | 32 | 17 | 0.7 |
| 1047582 | 72 | 29 | 12 | 7 | 0.3 |
| 1047584 | 100 | 60 | 23 | 11 | 0.6 |
| 1047613 | 107 | 107 | 79 | 44 | NC |
| 1047662 | 99 | 86 | 83 | 47 | NC |
| 1047707 | 100 | 126 | 91 | 75 | NC |
| 1048027 | 82 | 83 | 59 | 56 | NC |
| 1048350 | 104 | 85 | 57 | 36 | 3.4 |

TABLE 41

Dose-dependent percent of human GFAP RNA compared to untreated control in U251 cells by modified oligonucleotides

| Compound No. | GFAP RNA (% control) | | | | IC$_{50}$ (µM) |
|---|---|---|---|---|---|
| | 125 nM | 500 nM | 2000 nM | 8000 nM | |
| 1047235 | 80 | 81 | 68 | 57 | NC |
| 1047328 | 91 | 79 | 55 | 39 | 3.5 |
| 1047362 | 110 | 77 | 52 | 20 | 2.0 |
| 1047391 | 87 | 79 | 61 | 45 | 5.5 |
| 1047394 | 78 | 74 | 52 | 36 | 2.6 |
| 1047503 | 92 | 94 | 80 | 59 | NC |
| 1047522 | 81 | 81 | 63 | 50 | NC |
| 1047583 | 97 | 54 | 19 | 12 | 0.8 |
| 1047584 | 81 | 50 | 19 | 10 | 0.6 |
| 1047585 | 85 | 73 | 38 | 18 | 1.2 |
| 1047586 | 75 | 64 | 41 | 23 | 1.1 |
| 1047587 | 92 | 66 | 41 | 19 | 1.3 |
| 1047599 | 92 | 94 | 83 | 78 | NC |
| 1047601 | 103 | 89 | 68 | 50 | NC |
| 1047762 | 99 | 84 | 70 | 71 | NC |
| 1047955 | 95 | 104 | 86 | 92 | NC |
| 1048018 | 85 | 84 | 74 | 51 | NC |
| 1048351 | 98 | 97 | 75 | 59 | NC |
| 1048355 | 114 | 114 | 90 | 61 | NC |

TABLE 42

Dose-dependent percent of human GFAP RNA compared to untreated control in U251 cells by modified oligonucleotides

| Compound No. | GFAP RNA (% control) | | | | IC$_{50}$ (µM) |
|---|---|---|---|---|---|
| | 125 nM | 500 nM | 2000 nM | 8000 nM | |
| 1047429 | 80 | 58 | 32 | 15 | 0.8 |
| 1047444 | 80 | 98 | 83 | 73 | NC |
| 1047492 | 92 | 99 | 79 | 58 | NC |
| 1047573 | 80 | 74 | 59 | 44 | 4.7 |
| 1047584 | 87 | 53 | 20 | 8 | 0.7 |
| 1047588 | 69 | 49 | 24 | 14 | 0.5 |
| 1047589 | 101 | 79 | 47 | 24 | 2.0 |
| 1047590 | 70 | 55 | 35 | 24 | 0.7 |
| 1047591 | 92 | 67 | 34 | 21 | 1.2 |
| 1047734 | 86 | 75 | 69 | 60 | NC |
| 1047990 | 75 | 75 | 58 | 40 | 4.1 |
| 1048055 | 103 | 96 | 61 | 42 | 5.0 |
| 1048151 | 94 | 76 | 23 | 16 | 1.1 |
| 1048182 | 85 | 76 | 56 | 35 | 2.9 |
| 1048195 | 105 | 104 | 87 | 87 | NC |
| 1048196 | 94 | 91 | 73 | 62 | NC |
| 1048228 | 91 | 81 | 87 | 93 | NC |
| 1048341 | 80 | 71 | 61 | 46 | 6.1 |
| 1048372 | 94 | 88 | 84 | 59 | NC |

TABLE 43

Dose-dependent percent of human GFAP RNA compared to untreated control in U251 cells by modified oligonucleotides

| Compound No. | GFAP RNA (% control) | | | | IC$_{50}$ (µM) |
|---|---|---|---|---|---|
| | 125 nM | 500 nM | 2000 nM | 8000 nM | |
| 1047321 | 94 | 91 | 84 | 79 | NC |
| 1047337 | 94 | 89 | 68 | 61 | NC |
| 1047368 | 86 | 82 | 79 | 81 | NC |
| 1047385 | 86 | 80 | 63 | 58 | NC |
| 1047432 | 89 | 84 | 75 | 89 | NC |
| 1047465 | 82 | 67 | 62 | 49 | 7.3 |
| 1047469 | 104 | 95 | 73 | 58 | NC |
| 1047513 | 106 | 100 | 96 | 80 | NC |
| 1047576 | 82 | 83 | 63 | 49 | NC |
| 1047584 | 88 | 63 | 31 | 14 | 1.0 |
| 1047625 | 86 | 80 | 73 | 55 | NC |
| 1047675 | 101 | 88 | 92 | 82 | NC |
| 1047688 | 99 | 100 | 96 | 100 | NC |
| 1047705 | 100 | 92 | 78 | 68 | NC |
| 1047866 | 90 | 81 | 71 | 78 | NC |
| 1048187 | 103 | 91 | 86 | 84 | NC |
| 1048188 | 100 | 88 | 82 | 74 | NC |
| 1048188 | 99 | 64 | 80 | 81 | NC |
| 1048201 | 80 | 65 | 41 | 23 | 1.2 |

TABLE 44

Dose-dependent percent of human GFAP RNA compared to untreated control in U251 cells by modified oligonucleotides

| Compound No. | GFAP RNA (% control) | | | | IC$_{50}$ (µM) |
|---|---|---|---|---|---|
| | 125 nM | 500 nM | 2000 nM | 8000 nM | |
| 1047298 | 87 | 83 | 74 | 75 | NC |
| 1047474 | 102 | 93 | 94 | 87 | NC |
| 1047523 | 88 | 76 | 61 | 42 | 4.6 |
| 1047582 | 79 | 37 | 18 | 12 | 0.4 |
| 1047584 | 100 | 72 | 43 | 20 | 1.6 |
| 1047607 | 92 | 85 | 68 | 56 | NC |
| 1047717 | 106 | 110 | 92 | 80 | NC |
| 1047746 | 108 | 110 | 106 | 110 | NC |
| 1047790 | 91 | 86 | 81 | 70 | NC |
| 1047799 | 104 | 100 | 95 | 93 | NC |
| 1047840 | 92 | 88 | 75 | 58 | NC |
| 1047859 | 96 | 87 | 87 | 78 | NC |
| 1047886 | 84 | 79 | 68 | 68 | NC |
| 1047907 | 97 | 90 | 80 | 71 | NC |
| 1048093 | 97 | 89 | 93 | 90 | NC |
| 1048144 | 101 | 93 | 99 | 108 | NC |
| 1048207 | 97 | 82 | 76 | 74 | NC |
| 1048223 | 91 | 77 | 77 | 68 | NC |
| 1048350 | 104 | 80 | 57 | 44 | 4.4 |

TABLE 45

Dose-dependent percent of human GFAP RNA compared to untreated control in U251 cells by modified oligonucleotides

| | GFAP RNA (% control) | | | | |
|---|---|---|---|---|---|
| Compound No. | 370 nM | 1111 nM | 3333 nM | 10000 nM | IC50 (µM) |
| 1047582 | 25 | 11 | 7 | 5 | NC |
| 1072814 | 62 | 45 | 22 | 14 | 0.7 |
| 1072815 | 86 | 57 | 42 | 28 | 2.3 |
| 1072818 | 78 | 54 | 33 | 16 | 1.5 |
| 1072834 | 33 | 22 | 13 | 8 | NC |
| 1072835 | 54 | 30 | 15 | 9 | NC |
| 1072855 | 64 | 44 | 27 | 16 | 0.8 |
| 1072862 | 59 | 40 | 20 | 9 | 0.6 |
| 1072863 | 83 | 54 | 35 | 20 | 1.7 |
| 1072868 | 80 | 50 | 23 | 9 | 1.2 |
| 1072872 | 21 | 13 | 9 | 7 | NC |
| 1072886 | 88 | 60 | 42 | 21 | 2.2 |
| 1072986 | 84 | 68 | 22 | 11 | 1.7 |
| 1073003 | 93 | 79 | 71 | 52 | NC |
| 1073034 | 97 | 80 | 30 | 30 | 2.9 |
| 1073035 | 78 | 80 | 41 | 27 | 2.8 |
| 1073063 | 53 | 29 | 15 | 7 | NC |
| 1073106 | 87 | 76 | 57 | 39 | 5.2 |
| 1073107 | 79 | 65 | 58 | 33 | 3.7 |

TABLE 46

Dose-dependent percent of human GFAP RNA compared to untreated control in U251 cells by modified oligonucleotides

| | GFAP RNA (% control) | | | | |
|---|---|---|---|---|---|
| Compound No. | 370 nM | 1111 nM | 3333 nM | 10000 nM | IC50 (µM) |
| 1047582 | 36 | 15 | 8 | 6 | NC |
| 1072813 | 69 | 58 | 36 | 17 | 1.4 |
| 1072824 | 85 | 63 | 38 | 23 | 2.2 |
| 1072849 | 66 | 32 | 21 | 14 | 0.6 |
| 1072853 | 116 | 98 | 70 | 24 | 5.1 |
| 1072856 | 90 | 57 | 32 | 14 | 1.8 |
| 1072857 | 66 | 45 | 32 | 17 | 1.0 |
| 1072861 | 68 | 45 | 28 | 16 | 1.0 |
| 1072864 | 87 | 62 | 43 | 22 | 2.3 |
| 1072973 | 101 | 74 | 40 | 13 | 2.5 |
| 1072980 | 39 | 45 | 27 | 16 | NC |
| 1073009 | 87 | 75 | 83 | 35 | 8.2 |
| 1073033 | 87 | 44 | 19 | 24 | 1.4 |
| 1073045 | 60 | 43 | 24 | 12 | 0.7 |
| 1073060 | 68 | 43 | 28 | 16 | 0.9 |
| 1073064 | 61 | 41 | 31 | 19 | 0.7 |
| 1073065 | 69 | 61 | 36 | 18 | 1.5 |
| 1073077 | 95 | 70 | 44 | 23 | 2.8 |
| 1073093 | 57 | 33 | 20 | 10 | 0.5 |

TABLE 47

Dose-dependent percent of human GFAP RNA compared to untreated control in U251 cells by modified oligonucleotides

| | GFAP RNA (% control) | | | | |
|---|---|---|---|---|---|
| Compound No. | 370 nM | 1111 nM | 3333 nM | 10000 nM | IC50 (µM) |
| 1047582 | 70 | 30 | 9 | 5 | 0.6 |
| 1103198 | 91 | 86 | 82 | 73 | NC |
| 1103246 | 102 | 84 | 81 | 62 | NC |
| 1103278 | 89 | 96 | 72 | 51 | NC |
| 1103279 | 86 | 69 | 43 | 30 | 2.9 |
| 1103359 | 82 | 75 | 55 | 39 | 5.0 |
| 1103470 | 86 | 88 | 73 | 55 | NC |
| 1103471 | 68 | 63 | 45 | 36 | 2.6 |
| 1103502 | 104 | 93 | 75 | 51 | NC |
| 1103567 | 88 | 66 | 45 | 23 | 2.5 |

TABLE 47-continued

Dose-dependent percent of human GFAP RNA compared to untreated control in U251 cells by modified oligonucleotides

| | GFAP RNA (% control) | | | | |
|---|---|---|---|---|---|
| Compound No. | 370 nM | 1111 nM | 3333 nM | 10000 nM | IC50 (µM) |
| 1104014 | 91 | 91 | 56 | 56 | NC |
| 1104078 | 92 | 100 | 103 | 92 | NC |
| 1104127 | 67 | 52 | 42 | 33 | 1.6 |
| 1104144 | 93 | 63 | 34 | 16 | 2.1 |
| 1104158 | 50 | 51 | 55 | 23 | 1.0 |
| 1104159 | 65 | 59 | 40 | 25 | 1.6 |
| 1104174 | 91 | 93 | 63 | 43 | 7.9 |
| 1104175 | 69 | 46 | 23 | 13 | 0.9 |
| 1104191 | 84 | 76 | 52 | 34 | 4.0 |

TABLE 48

Dose-dependent percent of human GFAP RNA compared to untreated control in U251 cells by modified oligonucleotides

| | GFAP RNA (% control) | | | | |
|---|---|---|---|---|---|
| Compound No. | 370 nM | 1111 nM | 3333 nM | 10000 nM | IC50 (µM) |
| 1047582 | 66 | 30 | 11 | 6 | 0.6 |
| 1103202 | 79 | 79 | 54 | 43 | 6.0 |
| 1103217 | 77 | 38 | 16 | 5 | 0.9 |
| 1103218 | 92 | 74 | 50 | 33 | 3.7 |
| 1103330 | 84 | 79 | 56 | 51 | NC |
| 1103345 | 112 | 125 | 111 | 149 | NC |
| 1103377 | 115 | 134 | 142 | 151 | NC |
| 1103409 | 82 | 93 | 70 | 45 | NC |
| 1103570 | 79 | 64 | 43 | 24 | 2.3 |
| 1103571 | 101 | 74 | 61 | 34 | 4.6 |
| 1103872 | 93 | 79 | 28 | 21 | 2.4 |
| 1103970 | 88 | 78 | 75 | 74 | NC |
| 1104096 | 109 | 112 | 65 | 47 | 9.2 |
| 1104131 | 87 | 79 | 54 | 44 | 6.1 |
| 1104145 | 99 | 89 | 65 | 39 | 6.7 |
| 1104161 | 102 | 90 | 75 | 52 | NC |
| 1104178 | 72 | 67 | 57 | 53 | NC |
| 1104225 | 87 | 82 | 57 | 39 | 5.4 |
| 1104307 | 97 | 87 | 57 | 32 | 4.7 |

TABLE 49

Dose-dependent percent of human GFAP RNA compared to untreated control in U251 cells by modified oligonucleotides

| | GFAP RNA (% control) | | | | |
|---|---|---|---|---|---|
| Compound No. | 370 nM | 1111 nM | 3333 nM | 10000 nM | IC50 (µM) |
| 1047582 | 58 | 29 | 10 | 7 | 0.4 |
| 1103236 | 81 | 62 | 27 | 12 | 1.6 |
| 1103253 | 68 | 56 | 36 | 37 | 1.8 |
| 1103268 | 86 | 62 | 37 | 30 | 2.4 |
| 1103285 | 91 | 79 | 56 | 29 | 4.0 |
| 1103300 | 100 | 98 | 83 | 81 | NC |
| 1103365 | 83 | 86 | 64 | 42 | 8.2 |
| 1103428 | 87 | 73 | 50 | 26 | 3.2 |
| 1103491 | 86 | 70 | 70 | 55 | NC |
| 1103620 | 90 | 62 | 65 | 73 | NC |
| 1104037 | 77 | 92 | 66 | 38 | 7.8 |
| 1104116 | 85 | 63 | 42 | 23 | 2.3 |
| 1104118 | 99 | 74 | 38 | 20 | 2.6 |
| 1104132 | 107 | 79 | 53 | 35 | 4.5 |
| 1104133 | 70 | 67 | 43 | 29 | 2.3 |
| 1104165 | 91 | 86 | 59 | 32 | 4.8 |
| 1104276 | 94 | 71 | 18 | 15 | 1.9 |
| 1104309 | 73 | 60 | 36 | 20 | 1.6 |
| 1104310 | 82 | 57 | 30 | 13 | 1.6 |

TABLE 50

Dose-dependent percent of human GFAP RNA compared to untreated control in U251 cells by modified oligonucleotides

| Compound No. | GFAP RNA (% control) | | | | IC50 (µM) |
|---|---|---|---|---|---|
| | 370 nM | 1111 nM | 3333 nM | 10000 nM | |
| 1047582 | 69 | 30 | 11 | 7 | 0.6 |
| 1103241 | 87 | 71 | 60 | 50 | NC |
| 1103257 | 75 | 83 | 47 | 26 | 3.1 |
| 1103258 | 81 | 70 | 44 | 23 | 2.4 |
| 1103272 | 94 | 91 | 52 | 26 | 4.0 |
| 1103369 | 88 | 78 | 59 | 38 | 5.4 |
| 1103370 | 83 | 88 | 59 | 44 | 8.0 |
| 1103400 | 95 | 101 | 87 | 76 | NC |
| 1103448 | 91 | 73 | 49 | 32 | 3.6 |
| 1103465 | 88 | 68 | 47 | 31 | 3.1 |
| 1103592 | 96 | 111 | 75 | 48 | NC |
| 1103722* | 21 | 24 | 21 | 19 | NC |
| 1103816 | 108 | 118 | 95 | 76 | NC |
| 1104072 | 111 | 83 | 63 | 17 | 3.8 |
| 1104122 | 84 | 73 | 65 | 48 | NC |
| 1104153 | 78 | 83 | 55 | 50 | NC |
| 1104280 | 111 | 84 | 55 | 25 | 3.9 |
| 1104312 | 91 | 71 | 52 | 32 | 3.7 |
| 1104361 | 87 | 81 | 65 | 42 | 7.4 |

TABLE 51

Dose-dependent percent of human GFAP RNA compared to untreated control in U251 cells by modified oligonucleotides

| Compound No. | GFAP RNA (% control) | | | | IC50 (µM) |
|---|---|---|---|---|---|
| | 370 nM | 1111 nM | 3333 nM | 10000 nM | |
| 1047582 | 60 | 36 | 12 | 8 | 0.5 |
| 1103244 | 99 | 79 | 55 | 42 | 5.7 |
| 1103259 | 85 | 70 | 42 | 26 | 2.6 |
| 1103322 | 87 | 82 | 66 | 46 | 9.5 |
| 1103371 | 86 | 97 | 64 | 38 | 7.3 |
| 1103516 | 104 | 123 | 90 | 69 | NC |
| 1103837 | 82 | 62 | 40 | 26 | 2.2 |
| 1103899 | 94 | 87 | 68 | 48 | NC |
| 1103932 | 74 | 83 | 68 | 64 | NC |
| 1103933 | 79 | 63 | 11 | 9 | 1.3 |
| 1104093 | 90 | 61 | 33 | 24 | 2.1 |
| 1104123 | 91 | 114 | 81 | 61 | NC |
| 1104156 | 83 | 86 | 71 | 55 | NC |
| 1104173 | 87 | 89 | 60 | 42 | 7.2 |
| 1104298 | 105 | 102 | 80 | 57 | NC |
| 1104299 | 101 | 109 | 84 | 72 | NC |
| 1104349 | 104 | 71 | 57 | 35 | 4.3 |
| 1104365 | 95 | 75 | 63 | 40 | 5.8 |
| 1104380 | 95 | 83 | 61 | 45 | 7.3 |

TABLE 52

Dose-dependent percent of human GFAP RNA compared to untreated control in U251 cells by modified oligonucleotides

| Compound No. | GFAP RNA (% control) | | | | IC50 (µM) |
|---|---|---|---|---|---|
| | 370 nM | 1111 nM | 3333 nM | 10000 nM | |
| 1047582 | 63 | 26 | 10 | 6 | 0.5 |
| 1103254 | 93 | 85 | 62 | 37 | 5.8 |
| 1103255 | 59 | 49 | 23 | 14 | 0.8 |
| 1103256 | 84 | 54 | 22 | 10 | 1.4 |
| 1103366 | 105 | 79 | 58 | 58 | NC |
| 1103368 | 92 | 79 | 44 | 21 | 2.9 |
| 1103430 | 97 | 86 | 60 | 42 | 6.3 |
| 1103446 | 84 | 79 | 51 | 36 | 4.3 |
| 1103447 | 88 | 79 | 49 | 32 | 3.7 |
| 1103478 | 90 | 95 | 62 | 46 | 9.1 |
| 1103558 | 82 | 92 | 59 | 32 | 5.2 |
| 1103591 | 73 | 69 | 51 | 31 | 3.0 |
| 1104038 | 68 | 51 | 31 | 36 | 1.4 |
| 1104039 | 80 | 68 | 43 | 36 | 3.1 |
| 1104151 | 80 | 65 | 46 | 28 | 2.6 |
| 1104152 | 94 | 71 | 47 | 22 | 2.8 |
| 1104166 | 94 | 70 | 45 | 27 | 3.0 |
| 1104311 | 70 | 60 | 40 | 22 | 1.7 |
| 1104326 | 97 | 85 | 64 | 52 | NC |

Example 4: Tolerability of Modified Oligonucleotides Complementary to Human GFAP in Wild-Type Mice, 3 Hour Study Modified oligonucleotides described above were tested in wild-type female C57/B16 mice to assess the tolerability of the oligonucleotides. Wild-type female C57/B16 mice each received a single ICV dose of 700 µg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 53

Tolerability scores in mice at 700 µg dose

| Compound No. | 3 hr. FOB |
|---|---|
| PBS | 0 |
| 1047198 | 3 |
| 1047258 | 3 |
| 1047328 | 7 |
| 1047362 | 0 |
| 1047373 | 0 |
| 1047386 | 4 |
| 1047387 | 0 |
| 1047388 | 2 |
| 1047391 | 5 |
| 1047580 | 0 |
| 1047582 | 5 |
| 1047583 | 2 |
| 1047584 | 1 |
| 1047585 | 0 |
| 1047586 | 0 |
| 1047587 | 0 |
| 1047588 | 0 |
| 1047589 | 1 |
| 1047590 | 2 |
| 1047591 | 4 |
| 1047610 | 5 |

TABLE 53-continued

Tolerability scores in mice at 700 μg dose

| Compound No. | 3 hr. FOB |
|---|---|
| 1048203 | 5 |
| 1048267 | 6 |
| 1048350 | 4 |

TABLE 55

Tolerability scores in mice at 700 μg dose

| Compound No. | 3 hr. FOB |
|---|---|
| PBS | 0 |
| 1047211 | 2 |
| 1047223 | 0 |
| 1047225 | 1 |
| 1047298 | 0 |
| 1047306 | 0 |
| 1047316 | 2 |
| 1047352 | 4 |
| 1047353 | 2 |
| 1047402 | 2 |
| 1047432 | 0 |
| 1047522 | 0 |
| 1047523 | 2 |
| 1047532 | 2 |
| 1047579 | 2 |
| 1047598 | 4 |
| 1047602 | 5 |
| 1047662 | 4 |
| 1047679 | 2 |
| 1047711 | 2 |
| 1047811 | 0 |
| 1047884 | 3 |
| 1048201 | 1 |
| 1048204 | 0 |
| 1048227 | 1 |

TABLE 54

Tolerability scores in mice at 700 μg dose

| Compound No. | 3 hr. FOB |
|---|---|
| PBS | 0 |
| 1047257 | 5 |
| 1047357 | 7 |
| 1047374 | 5 |
| 1047394 | 6 |
| 1047429 | 0 |
| 1047444 | 2 |
| 1047448 | 0 |
| 1047492 | 2 |
| 1047497 | 2 |
| 1047500 | 1 |
| 1047518 | 5 |
| 1047573 | 1 |
| 1047581 | 1 |
| 1047599 | 1 |
| 1047601 | 6 |
| 1047608 | 2 |
| 1047609 | 5 |
| 1047913 | 1 |
| 1047990 | 2 |
| 1048027 | 2 |
| 1048151 | 4 |
| 1048182 | 0 |
| 1048296 | 3 |
| 1048361 | 0 |

TABLE 56

Tolerability scores in mice at 700 μg dose

| Compound No. | 3 hr. FOB |
|---|---|
| PBS | 0 |
| 1072813 | 0 |
| 1072814 | 1 |
| 1072818 | 4 |
| 1072834 | 4 |
| 1072835 | 0 |
| 1072849 | 5 |
| 1072855 | 4 |
| 1072856 | 6 |
| 1072857 | 4 |
| 1072861 | 6 |
| 1072862 | 4 |
| 1072863 | 3 |
| 1072868 | 7 |
| 1072872 | 5 |
| 1072886 | 1 |
| 1072980 | 1 |
| 1072986 | 6 |
| 1073033 | 5 |
| 1073045 | 6 |
| 1073060 | 6 |
| 1073063 | 6 |
| 1073064 | 6 |
| 1073065 | 6 |
| 1073093 | 6 |

TABLE 57

Tolerability scores in mice at 700 μg dose

| Compound No. | 3 hr. FOB |
|---|---|
| PBS | 0 |
| 1103217 | 5 |
| 1103368 | 3 |
| 1103370 | 3 |
| 1103371 | 3 |
| 1103465 | 6 |
| 1103502 | 5 |
| 1103516 | 7 |
| 1103567 | 5 |
| 1103837 | 4 |
| 1103899 | 2 |
| 1104093 | 5 |
| 1104118 | 6 |
| 1104133 | 6 |
| 1104145 | 2 |
| 1104152 | 5 |
| 1104158 | 3 |
| 1104166 | 5 |
| 1104168 | 4 |
| 1104175 | 6 |
| 1104307 | 4 |
| 1104309 | 5 |
| 1104310 | 6 |
| 1104311 | 5 |
| 1104349 | 7 |

TABLE 58

Tolerability scores in mice at 700 μg dose

| Compound No. | 3 hr. FOB |
|---|---|
| PBS | 0 |
| 1103202 | 5 |
| 1103218 | 7 |
| 1103253 | 7 |
| 1103255 | 7 |
| 1103256 | 7 |
| 1103257 | 6 |

TABLE 58-continued

Tolerability scores in mice at 700 μg dose

| Compound No. | 3 hr. FOB |
|---|---|
| 1103258 | 7 |
| 1103259 | 6 |
| 1103268 | 1 |
| 1103279 | 6 |
| 1103285 | 7 |
| 1103411 | 7 |
| 1103471 | 6 |
| 1103570 | 6 |
| 1103722 | 1 |
| 1103872 | 4 |
| 1103933 | 7 |
| 1104038 | 7 |
| 1104116 | 1 |
| 1104127 | 3 |
| 1104144 | 3 |
| 1104159 | 5 |
| 1104276 | 1 |

Example 5: Design of MOE Gapmer Modified Oligonucleotides with Mixed PO/PS Internucleoside Linkages Complementary to a Human GFAP Nucleic Acid Modified oligonucleotides complementary to human GFAP nucleic acid were designed. The modified oligonucleotides in the table below are 6-10-4 MOE gapmers. The gapmers are 20 nucleosides in length and have a central gap segment that consists of ten 2'-β-D-deoxynucleosides, a 5' wing segment that consists of six 2'-β-D-MOE nucleosides, and a 3' wing segment that consists of four 2'-β-D-MOE nucleosides. The sugar motif of the gapmers is (from 5' to 3'): eeeeeedddddddddddeeee; wherein 'd' represents a 2'-β-D-deoxyribosyl sugar moiety, and 'e' represents a 2'-β-D-MOE sugar moiety. The gapmers have an internucleoside linkage motif of (from 5' to 3'): sooooossssssssssoss; wherein each "s" represents a phosphorothioate internucleoside linkage and each "o" represents a phosphodiester internucleoside linkage. Each cytosine nucleoside is a 5-methylcytosine.

TABLE 59

6-10-4 MOE gapmers with mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166991 | CAGCCTGGTTAGCCTTTCTG | N/A | N/A | 9514 | 9533 | 2017 |
| 1166992 | TCAGCCTGGTTAGCCTTTCT | N/A | N/A | 9515 | 9534 | 2094 |
| 1166993 | GTCAGCCTGGTTAGCCTTTC | N/A | N/A | 9516 | 9535 | 2171 |
| 1166994 | AGTCAGCCTGGTTAGCCTTT | N/A | N/A | 9517 | 9536 | 1484 |
| 1166996 | CTAGTCAGCCTGGTTAGCCT | N/A | N/A | 9519 | 9538 | 1561 |
| 1166997 | ACTAGTCAGCCTGGTTAGCC | N/A | N/A | 9520 | 9539 | 2325 |
| 1166998 | CAGTATTACCTCTACTAGTC | N/A | N/A | 9533 | 9552 | 20 |
| 1166999 | GCAGTATTACCTCTACTAGT | N/A | N/A | 9534 | 9553 | 88 |
| 1167000 | GGCAGTATTACCTCTACTAG | N/A | N/A | 9535 | 9554 | 1637 |
| 1167001 | TGGCAGTATTACCTCTACTA | N/A | N/A | 9536 | 9555 | 166 |
| 1167002 | TTGGCAGTATTACCTCTACT | N/A | N/A | 9537 | 9556 | 1865 |
| 1167003 | TTTGGCAGTATTACCTCTAC | N/A | N/A | 9538 | 9557 | 1941 |
| 1167004 | ATTTGGCAGTATTACCTCTA | N/A | N/A | 9539 | 9558 | 2018 |
| 1167024 | GTGTATTAGGATCCCATCTA | N/A | N/A | 11155 | 11174 | 2028 |
| 1167025 | TGTGTATTAGGATCCCATCT | N/A | N/A | 11156 | 11175 | 2105 |
| 1167026 | GTGTGTATTAGGATCCCATC | N/A | N/A | 11157 | 11176 | 1569 |
| 1167027 | AGTGTGTATTAGGATCCCAT | N/A | N/A | 11158 | 11177 | 2182 |
| 1167050 | CTTTATTTTCCTCAGCGAC | 3045 | 3064 | 13334 | 13353 | 361 |
| 1167051 | TCTTTATTTTCCTCAGCGA | 3046 | 3065 | 13335 | 13354 | 439 |
| 1167053 | TGTCTTTATTTTCCTCAGC | 3048 | 3067 | 13337 | 13356 | 595 |
| 1167054 | TTGTCTTTATTTTCCTCAG | 3049 | 3068 | 13338 | 13357 | 673 |
| 1167055 | TTTGTCTTTATTTTCCTCA | 3050 | 3069 | 13339 | 13358 | 751 |
| 1167056 | ATTTGTCTTTATTTTCCTC | 3051 | 3070 | 13340 | 13359 | 829 |

TABLE 59-continued 6-10-4 MOE gapmers with mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166975 | TTGTGATTTTCCCCGTCTTT | N/A | N/A | 8755 | 8774 | 908 |
| 1166984 | ACATTCACTAATATTTAACA | N/A | N/A | 9323 | 9342 | 1022 |
| 1166985 | CACATTCACTAATATTTAAC | N/A | N/A | 9324 | 9343 | 21 |
| 1166986 | TCACATTCACTAATATTTAA | N/A | N/A | 9325 | 9344 | 2321 |
| 1166987 | GTCACATTCACTAATATTTA | N/A | N/A | 9326 | 9345 | 1177 |
| 1166988 | CGTCACATTCACTAATATTT | N/A | N/A | 9327 | 9346 | 2398 |
| 1166989 | ACGTCACATTCACTAATATT | N/A | N/A | 9328 | 9347 | 2808 |
| 1166990 | CACGTCACATTCACTAATAT | N/A | N/A | 9329 | 9348 | 2809 |
| 1167057 | CATTTGTCTTTATTTTTCCT | 3052 | 3071 | 13341 | 13360 | 907 |
| 1167059 | AGCATTTGTCTTTATTTTTC | 3054 | 3073 | 13343 | 13362 | 1063 |
| 1167060 | CAGCATTTGTCTTTATTTTT | 3055 | 3074 | 13344 | 13363 | 1140 |
| 1166982 | GCTTTTGAGATATCTTGTGA | N/A | N/A | 8777 | 8796 | 51 |
| 1167007 | TGACTATCTAGGATTTGGCA | N/A | N/A | 9551 | 9570 | 2480 |
| 1167011 | CCTGTGACTATCTAGGATTT | N/A | N/A | 9555 | 9574 | 2709 |
| 1167012 | TTTATCTGTGCTTTAGTGAC | N/A | N/A | 9574 | 9593 | 2710 |
| 1167017 | TGCCATTTATCTGTGCTTTA | N/A | N/A | 9579 | 9598 | 1639 |
| 1167018 | CTGCCATTTATCTGTGCTTT | N/A | N/A | 9580 | 9599 | 1867 |
| 1174062 | GCTTTTGCCCCCTGTAGTGA | N/A | N/A | 8732 | 8751 | 2291 |
| 1174063 | GTGCTTTTGCCCCCTGTAGT | N/A | N/A | 8734 | 8753 | 2368 |
| 1174065 | TGGTGCTTTTGCCCCCTGTA | N/A | N/A | 8736 | 8755 | 2445 |
| 1174066 | TTGGTGCTTTTGCCCCCTGT | N/A | N/A | 8737 | 8756 | 59 |
| 1167033 | GCACAGTTCCCAGATACTCC | 1756 | 1775 | 12045 | 12064 | 426 |
| 1167034 | GGCACAGTTCCCAGATACTC | 1757 | 1776 | 12046 | 12065 | 504 |
| 1167035 | AGGCACAGTTCCCAGATACT | 1758 | 1777 | 12047 | 12066 | 1425 |
| 1167036 | AAGGCACAGTTCCCAGATAC | 1759 | 1778 | 12048 | 12067 | 1502 |
| 1167037 | AAAGGCACAGTTCCCAGATA | 1760 | 1779 | 12049 | 12068 | 582 |
| 1167040 | CTCAGTTTTCCTCCAGCAGC | 1792 | 1811 | 12081 | 12100 | 115 |
| 1167046 | GCCAGTGTCTTCACTTTGCT | 2750 | 2769 | 13039 | 13058 | 1973 |
| 1167058 | GCATTTGTCTTTATTTTTCC | 3053 | 3072 | 13342 | 13361 | 985 |

Modified oligonucleotides in the table below are 5-10-5 MOE gapmers with mixed P0/PS internucleoside linkages. The gapmers are 20 nucleosides in length, wherein the central gap segment consists of ten 2'-β-D-deoxynucleosides and the 5' and 3' wing segments each consist of five 2'-β-D-MOE modified nucleosides. The sugar motif for the gapmers is (from 5' to 3'): eeeeedddddddddddeeeee; wherein 'd' represents a 2'-β-D-deoxyribosyl sugar moiety, and 'e' represents a 2'-β-D-MOE sugar moiety. The gapmers have an internucleoside linkage motif of (from 5' to 3'): soooosssssssssssooss; wherein each "s" represents a phosphorothioate internucleoside linkage and each "o" represents a phosphodiester internucleoside linkage. Each cytosine nucleoside is a 5-methylcytosine.

TABLE 60

5-10-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166900 | CAGCCTGGTTAGCCTTTCTG | N/A | N/A | 9514 | 9533 | 2017 |
| 1166901 | TCAGCCTGGTTAGCCTTTCT | N/A | N/A | 9515 | 9534 | 2094 |
| 1166902 | GTCAGCCTGGTTAGCCTTTC | N/A | N/A | 9516 | 9535 | 2171 |
| 1166903 | AGTCAGCCTGGTTAGCCTTT | N/A | N/A | 9517 | 9536 | 1484 |
| 1166904 | TAGTCAGCCTGGTTAGCCTT | N/A | N/A | 9518 | 9537 | 2248 |
| 1166905 | CTAGTCAGCCTGGTTAGCCT | N/A | N/A | 9519 | 9538 | 1561 |
| 1166906 | ACTAGTCAGCCTGGTTAGCC | N/A | N/A | 9520 | 9539 | 2325 |
| 1166907 | CAGTATTACCTCTACTAGTC | N/A | N/A | 9533 | 9552 | 20 |
| 1166909 | GGCAGTATTACCTCTACTAG | N/A | N/A | 9535 | 9554 | 1637 |
| 1166910 | TGGCAGTATTACCTCTACTA | N/A | N/A | 9536 | 9555 | 166 |
| 1166911 | TTGGCAGTATTACCTCTACT | N/A | N/A | 9537 | 9556 | 1865 |
| 1166912 | TTTGGCAGTATTACCTCTAC | N/A | N/A | 9538 | 9557 | 1941 |
| 1166913 | ATTTGGCAGTATTACCTCTA | N/A | N/A | 9539 | 9558 | 2018 |
| 1166932 | TGTATTAGGATCCCATCTAG | N/A | N/A | 11154 | 11173 | 1951 |
| 1166933 | GTGTATTAGGATCCCATCTA | N/A | N/A | 11155 | 11174 | 2028 |
| 1166934 | TGTGTATTAGGATCCCATCT | N/A | N/A | 11156 | 11175 | 2105 |
| 1166885 | CTTGTGATTTTCCCCGTCTT | N/A | N/A | 8756 | 8775 | 986 |
| 1166886 | CCTTGTGATTTTCCCCGTCT | N/A | N/A | 8757 | 8776 | 1064 |
| 1166887 | TTGAGATATCTTGTGACCTT | N/A | N/A | 8773 | 8792 | 1510 |
| 1166888 | TTTGAGATATCTTGTGACCT | N/A | N/A | 8774 | 8793 | 1280 |
| 1166890 | CTTTTGAGATATCTTGTGAC | N/A | N/A | 8776 | 8795 | 1434 |
| 1166893 | ACATTCACTAATATTTAACA | N/A | N/A | 9323 | 9342 | 1022 |
| 1166894 | CACATTCACTAATATTTAAC | N/A | N/A | 9324 | 9343 | 21 |
| 1166895 | TCACATTCACTAATATTTAA | N/A | N/A | 9325 | 9344 | 2321 |
| 1166896 | GTCACATTCACTAATATTTA | N/A | N/A | 9326 | 9345 | 1177 |
| 1166897 | CGTCACATTCACTAATATTT | N/A | N/A | 9327 | 9346 | 2398 |
| 1166898 | ACGTCACATTCACTAATATT | N/A | N/A | 9328 | 9347 | 2808 |
| 1166899 | CACGTCACATTCACTAATAT | N/A | N/A | 9329 | 9348 | 2809 |
| 1166916 | TGACTATCTAGGATTTGGCA | N/A | N/A | 9551 | 9570 | 2480 |
| 1166920 | CCTGTGACTATCTAGGATTT | N/A | N/A | 9555 | 9574 | 2709 |
| 1166926 | TGCCATTTATCTGTGCTTTA | N/A | N/A | 9579 | 9598 | 1639 |
| 1166927 | CTGCCATTTATCTGTGCTTT | N/A | N/A | 9580 | 9599 | 1867 |
| 1166928 | TCTGCCATTTATCTGTGCTT | N/A | N/A | 9581 | 9600 | 400 |
| 1166929 | CTCTGCCATTTATCTGTGCT | N/A | N/A | 9582 | 9601 | 1943 |
| 1174056 | GCTTTTGCCCCCTGTAGTGA | N/A | N/A | 8732 | 8751 | 2291 |
| 1174058 | GGTGCTTTTGCCCCCTGTAG | N/A | N/A | 8735 | 8754 | 1227 |

TABLE 60-continued 5-10-5 MOE gapmers with a mixed PO/PS internucleoside
linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1174059 | TGGTGCTTTTGCCCCCTGTA | N/A | N/A | 8736 | 8755 | 2445 |
| 1174060 | TTGGTGCTTTTGCCCCCTGT | N/A | N/A | 8737 | 8756 | 59 |
| 1174061 | TTTGGTGCTTTTGCCCCCTG | N/A | N/A | 8738 | 8757 | 2522 |
| 1166940 | ACAGTTCCCAGATACTCCGA | 1754 | 1773 | 12043 | 12062 | 270 |
| 1166946 | AAAGGCACAGTTCCCAGATA | 1760 | 1779 | 12049 | 12068 | 582 |
| 1166948 | TCAGTTTTCCTCCAGCAGCC | 1791 | 1810 | 12080 | 12099 | 37 |
| 1166954 | CCAGTGTCTTCACTTTGCTC | 2749 | 2768 | 13038 | 13057 | 825 |
| 1199982 | GGTCCTAAATATTCTAGTCC | N/A | N/A | 9459 | 9478 | 2093 |
| 1199983 | TGGTCCTAAATATTCTAGTC | N/A | N/A | 9460 | 9479 | 2170 |
| 1199984 | GTGGTCCTAAATATTCTAGT | N/A | N/A | 9461 | 9480 | 2813 |

The modified oligonucleotides in the table below are 4-10-6 MOE gapmers. The gapmers are 20 nucleosides in length and have a central gap segment that consists of ten 2'-β-D-deoxynucleosides, a 5' wing segment that consists of four 2'-β-D-MOE nucleosides, and a 3' wing segment that consists of six 2'-β-D-MOE nucleosides. The sugar motif of the gapmers is (from 5' to 3'): eeeedddddddddddeeeeee; wherein 'd' represents a 2'-β-D-deoxyribosyl sugar moiety, and 'e' represents a 2'-β-D-MOE sugar moiety. The gapmers have an internucleoside linkage motif of (from 5' to 3'): sooosssssssssssoooss; wherein "s" represents a phosphorothioate internucleoside linkage and "o" represents a phosphodiester internucleoside linkage. Each cytosine nucleoside is a 5-methylcytosine.

TABLE 61

4-10-6 MOE gapmers with a mixed PO/PS internucleoside
linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166809 | CAGCCTGGTTAGCCTTTCTG | N/A | N/A | 9514 | 9533 | 2017 |
| 1166810 | TCAGCCTGGTTAGCCTTTCT | N/A | N/A | 9515 | 9534 | 2094 |
| 1166812 | AGTCAGCCTGGTTAGCCTTT | N/A | N/A | 9517 | 9536 | 1484 |
| 1166813 | TAGTCAGCCTGGTTAGCCTT | N/A | N/A | 9518 | 9537 | 2248 |
| 1166814 | CTAGTCAGCCTGGTTAGCCT | N/A | N/A | 9519 | 9538 | 1561 |
| 1166815 | ACTAGTCAGCCTGGTTAGCC | N/A | N/A | 9520 | 9539 | 2325 |
| 1166816 | CAGTATTACCTCTACTAGTC | N/A | N/A | 9533 | 9552 | 20 |
| 1166817 | GCAGTATTACCTCTACTAGT | N/A | N/A | 9534 | 9553 | 88 |
| 1166818 | GGCAGTATTACCTCTACTAG | N/A | N/A | 9535 | 9554 | 1637 |
| 1166819 | TGGCAGTATTACCTCTACTA | N/A | N/A | 9536 | 9555 | 166 |
| 1166820 | TTGGCAGTATTACCTCTACT | N/A | N/A | 9537 | 9556 | 1865 |
| 1166821 | TTTGGCAGTATTACCTCTAC | N/A | N/A | 9538 | 9557 | 1941 |
| 1166822 | ATTTGGCAGTATTACCTCTA | N/A | N/A | 9539 | 9558 | 2018 |
| 1166841 | TGTATTAGGATCCCATCTAG | N/A | N/A | 11154 | 11173 | 1951 |
| 1166842 | GTGTATTAGGATCCCATCTA | N/A | N/A | 11155 | 11174 | 2028 |

TABLE 61-continued 4-10-6 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166843 | TGTGTATTAGGATCCCATCT | N/A | N/A | 11156 | 11175 | 2105 |
| 1166845 | AGTGTGTATTAGGATCCCAT | N/A | N/A | 11158 | 11177 | 2182 |
| 1166846 | GAGTGTGTATTAGGATCCCA | N/A | N/A | 11159 | 11178 | 2259 |
| 1166847 | AGAGTGTGTATTAGGATCCC | N/A | N/A | 11160 | 11179 | 2336 |
| 1166869 | TCTTTATTTTTCCTCAGCGA | 3046 | 3065 | 13335 | 13354 | 439 |
| 1166870 | GTCTTTATTTTTCCTCAGCG | 3047 | 3066 | 13336 | 13355 | 517 |
| 1166871 | TGTCTTTATTTTTCCTCAGC | 3048 | 3067 | 13337 | 13356 | 595 |
| 1166872 | TTGTCTTTATTTTTCCTCAG | 3049 | 3068 | 13338 | 13357 | 673 |
| 1166873 | TTTGTCTTTATTTTTCCTCA | 3050 | 3069 | 13339 | 13358 | 751 |
| 1166874 | ATTTGTCTTTATTTTTCCTC | 3051 | 3070 | 13340 | 13359 | 829 |
| 1166793 | TTGTGATTTTCCCCGTCTTT | N/A | N/A | 8755 | 8774 | 908 |
| 1166794 | CTTGTGATTTTCCCCGTCTT | N/A | N/A | 8756 | 8775 | 986 |
| 1166795 | CCTTGTGATTTTCCCCGTCT | N/A | N/A | 8757 | 8776 | 1064 |
| 1166798 | TTTTGAGATATCTTGTGACC | N/A | N/A | 8775 | 8794 | 1357 |
| 1166799 | CTTTTGAGATATCTTGTGAC | N/A | N/A | 8776 | 8795 | 1434 |
| 1166800 | GCTTTTGAGATATCTTGTGA | N/A | N/A | 8777 | 8796 | 51 |
| 1166802 | ACATTCACTAATATTTAACA | N/A | N/A | 9323 | 9342 | 1022 |
| 1166803 | CACATTCACTAATATTTAAC | N/A | N/A | 9324 | 9343 | 21 |
| 1166804 | TCACATTCACTAATATTTAA | N/A | N/A | 9325 | 9344 | 2321 |
| 1166805 | GTCACATTCACTAATATTTA | N/A | N/A | 9326 | 9345 | 1177 |
| 1166806 | CGTCACATTCACTAATATTT | N/A | N/A | 9327 | 9346 | 2398 |
| 1166807 | ACGTCACATTCACTAATATT | N/A | N/A | 9328 | 9347 | 2808 |
| 1166808 | CACGTCACATTCACTAATAT | N/A | N/A | 9329 | 9348 | 2809 |
| 1166867 | TTTATTTTTCCTCAGCGACT | 3044 | 3063 | 13333 | 13352 | 283 |
| 1166875 | CATTTGTCTTTATTTTTCCT | 3052 | 3071 | 13341 | 13360 | 907 |
| 1166877 | AGCATTTGTCTTTATTTTTC | 3054 | 3073 | 13343 | 13362 | 1063 |
| 1166878 | CAGCATTTGTCTTTATTTTT | 3055 | 3074 | 13344 | 13363 | 1140 |
| 1166823 | ACTATCTAGGATTTGGCAGT | N/A | N/A | 9549 | 9568 | 2326 |
| 1166826 | GTGACTATCTAGGATTTGGC | N/A | N/A | 9552 | 9571 | 1408 |
| 1166831 | ATTTATCTGTGCTTTAGTGA | N/A | N/A | 9575 | 9594 | 2786 |
| 1166835 | TGCCATTTATCTGTGCTTTA | N/A | N/A | 9579 | 9598 | 1639 |
| 1174050 | GCTTTTGCCCCCTGTAGTGA | N/A | N/A | 8732 | 8751 | 2291 |
| 1174051 | GTGCTTTTGCCCCCTGTAGT | N/A | N/A | 8734 | 8753 | 2368 |
| 1174053 | TGGTGCTTTTGCCCCCTGTA | N/A | N/A | 8736 | 8755 | 2445 |
| 1174054 | TTGGTGCTTTTGCCCCCTGT | N/A | N/A | 8737 | 8756 | 59 |
| 1166852 | GGCACAGTTCCCAGATACTC | 1757 | 1776 | 12046 | 12065 | 504 |

The modified oligonucleotides in the table below are 5-8-5 MOE gapmers. The gapmers are 20 nucleosides in length and have a central gap segment that consists of eight 2'-β-D-deoxynucleosides, a 5' wing segment that consists of five 2'-β-D-MOE nucleosides, and a 3' wing segment that consists of five 2'-β-D-MOE nucleosides. The sugar motif of the gapmers is (from 5' to 3'): eeeeedddddddddeeeee; wherein 'd' represents a 2'-β-D-deoxyribosyl sugar moiety, and 'e' represents a 2'-β-D-MOE sugar moiety. The gapmers have an internucleoside linkage motif of (from 5' to 3'): sooosssssssssooss; wherein each "s" represents a phosphorothioate internucleoside linkage and each "o" represents a phosphodiester internucleoside linkage. Each cytosine nucleobase is a 5-methylcytosine.

TABLE 62

5-8-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166719 | GCAGTATTACCTCTACTA | N/A | N/A | 9536 | 9553 | 2816 |
| 1166720 | GGCAGTATTACCTCTACT | N/A | N/A | 9537 | 9554 | 2817 |
| 1166721 | TGGCAGTATTACCTCTAC | N/A | N/A | 9538 | 9555 | 2818 |
| 1166749 | TCAGCCTGGTTAGCCTTT | N/A | N/A | 9517 | 9534 | 2819 |
| 1166750 | GTCAGCCTGGTTAGCCTT | N/A | N/A | 9518 | 9535 | 2820 |
| 1166751 | AGTCAGCCTGGTTAGCCT | N/A | N/A | 9519 | 9536 | 2821 |
| 1166761 | GTGTATTAGGATCCCATC | N/A | N/A | 11157 | 11174 | 2822 |
| 1166762 | TGTGTATTAGGATCCCAT | N/A | N/A | 11158 | 11175 | 2823 |
| 1166763 | GTGTGTATTAGGATCCCA | N/A | N/A | 11159 | 11176 | 2824 |
| 1166775 | TTATTTTCCTCAGCGAC | 3045 | 3062 | 13334 | 13351 | 2825 |
| 1166776 | TTTATTTTCCTCAGCGA | 3046 | 3063 | 13335 | 13352 | 2826 |
| 1166777 | CTTTATTTTCCTCAGCG | 3047 | 3064 | 13336 | 13353 | 2827 |
| 1166778 | TCTTTATTTTCCTCAGC | 3048 | 3065 | 13337 | 13354 | 2828 |
| 1166779 | GTCTTTATTTTCCTCAG | 3049 | 3066 | 13338 | 13355 | 2829 |
| 1166780 | TGTCTTTATTTTCCTCA | 3050 | 3067 | 13339 | 13356 | 2830 |
| 1166781 | TTGTCTTTATTTTCCTC | 3051 | 3068 | 13340 | 13357 | 2831 |
| 1166782 | TTTGTCTTTATTTTCCT | 3052 | 3069 | 13341 | 13358 | 2832 |
| 1166783 | ATTTGTCTTTATTTTCC | 3053 | 3070 | 13342 | 13359 | 2833 |
| 1166738 | GTGATTTTCCCCGTCTTT | N/A | N/A | 8755 | 8772 | 2835 |
| 1166739 | TGTGATTTTCCCCGTCTT | N/A | N/A | 8756 | 8773 | 2836 |
| 1166740 | GAGATATCTTGTGACCTT | N/A | N/A | 8773 | 8790 | 2837 |
| 1166742 | TTGAGATATCTTGTGACC | N/A | N/A | 8775 | 8792 | 2839 |
| 1166746 | CACATTCACTAATATTTA | N/A | N/A | 9326 | 9343 | 2840 |
| 1166747 | TCACATTCACTAATATTT | N/A | N/A | 9327 | 9344 | 2841 |
| 1166748 | GTCACATTCACTAATATT | N/A | N/A | 9328 | 9345 | 2842 |
| 1166784 | CATTTGTCTTTATTTTC | 3054 | 3071 | 13343 | 13360 | 2843 |
| 1166785 | GCATTTGTCTTTATTTTT | 3055 | 3072 | 13344 | 13361 | 2844 |
| 1166786 | AGCATTTGTCTTTATTTT | 3056 | 3073 | 13345 | 13362 | 2845 |
| 1166787 | CAGCATTTGTCTTTATTT | 3057 | 3074 | 13346 | 13363 | 2846 |
| 1174012 | TTGTGATTTTCCCCGTCT | N/A | N/A | 8757 | 8774 | 2850 |
| 1174013 | TTTGAGATATCTTGTGAC | N/A | N/A | 8776 | 8793 | 2851 |

TABLE 62-continued 5-8-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1174015 | ATTCACTAATATTTAACA | N/A | N/A | 9323 | 9340 | 2852 |
| 1174016 | CATTCACTAATATTTAAC | N/A | N/A | 9324 | 9341 | 2853 |
| 1174018 | CGTCACATTCACTAATAT | N/A | N/A | 9329 | 9346 | 2854 |
| 1174020 | AGCCTGGTTAGCCTTTCT | N/A | N/A | 9515 | 9532 | 2856 |
| 1174024 | AGTATTACCTCTACTAGT | N/A | N/A | 9534 | 9551 | 2859 |
| 1174026 | TTGGCAGTATTACCTCTA | N/A | N/A | 9539 | 9556 | 2861 |
| 1174036 | TATTAGGATCCCATCTAG | N/A | N/A | 11154 | 11171 | 2862 |
| 1174037 | GTATTAGGATCCCATCTA | N/A | N/A | 11155 | 11172 | 2863 |
| 1166744 | GCTTTTGAGATATCTTGT | N/A | N/A | 8779 | 8796 | 2866 |
| 1166757 | CCATTTATCTGTGCTTTA | N/A | N/A | 9579 | 9596 | 2873 |
| 1166758 | TGCCATTTATCTGTGCTT | N/A | N/A | 9581 | 9598 | 2874 |
| 1166759 | CTGCCATTTATCTGTGCT | N/A | N/A | 9582 | 9599 | 2875 |
| 1166760 | TCTGCCATTTATCTGTGC | N/A | N/A | 9583 | 9600 | 2876 |
| 1174029 | ACTATCTAGGATTTGGCA | N/A | N/A | 9551 | 9568 | 2886 |
| 1174030 | TGTGACTATCTAGGATTT | N/A | N/A | 9555 | 9572 | 2887 |
| 1174031 | TATCTGTGCTTTAGTGAC | N/A | N/A | 9574 | 9591 | 2888 |
| 1174034 | GCCATTTATCTGTGCTTT | N/A | N/A | 9580 | 9597 | 2891 |

Example 6: Tolerability of Modified Oligonucleotides Complementary to Human GFAP in Wild-Type Mice, 3 Hour Study Modified oligonucleotides described above were tested in wild-type female C57/B16 mice to assess the tolerability of the oligonucleotides. Wild-type female C57/B16 mice each received a single ICV dose of 700 µg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 63

Tolerability scores in mice at 700 µg dose

| Compound No. | 3 hr. FOB |
|---|---|
| PBS | 0 |
| 1166719 | 1 |
| 1166720 | 0 |
| 1166721 | 0 |
| 1166749 | 3 |
| 1166750 | 1 |
| 1166751 | 2 |
| 1166761 | 4 |
| 1166762 | 4 |
| 1166763 | 3 |
| 1166775 | 0 |
| 1166776 | 1 |
| 1166777 | 4 |
| 1166778 | 1 |
| 1166779 | 4 |
| 1166780 | 1 |
| 1166781 | 0 |
| 1166782 | 0 |
| 1166783 | 0 |
| 1166809 | 4 |
| 1166810 | 4 |
| 1166812 | 3 |
| 1166813 | 3 |

TABLE 64

Tolerability scores in mice at 700 µg dose

| Compound No. | 3 hr. FOB |
|---|---|
| PBS | 0 |
| 1166814 | 4 |
| 1166815 | 2 |
| 1166816 | 1 |
| 1166817 | 1 |
| 1166818 | 3 |
| 1166819 | 1 |
| 1166820 | 1 |
| 1166821 | 1 |
| 1166822 | 3 |
| 1166841 | 3 |
| 1166842 | 3 |
| 1166843 | 3 |
| 1166845 | 5 |
| 1166846 | 4 |
| 1166847 | 5 |
| 1166869 | 1 |
| 1166870 | 3 |
| 1166871 | 2 |
| 1166872 | 2 |
| 1166873 | 1 |
| 1166874 | 0 |
| 1166900 | 5 |

TABLE 65

Tolerability scores in mice at 700 µg dose

| Compound No. | 3 hr. FOB |
|---|---|
| PBS | 0 |
| 1166901 | 4 |
| 1166902 | 5 |
| 1166903 | 4 |
| 1166904 | 4 |
| 1166905 | 2 |
| 1166906 | 2 |
| 1166907 | 0 |
| 1166909 | 3 |
| 1166910 | 1 |
| 1166911 | 0 |
| 1166912 | 1 |
| 1166913 | 2 |
| 1166932 | 4 |
| 1166933 | 2 |
| 1166934 | 3 |
| 1166991 | 4 |
| 1166992 | 4 |
| 1166993 | 4 |
| 1166994 | 3 |

TABLE 66

Tolerability scores in mice at 700 µg dose

| Compound No. | 3 hr. FOB |
|---|---|
| PBS | 0 |
| 1166996 | 4 |
| 1166997 | 4 |
| 1166998 | 0 |
| 1166999 | 0 |
| 1167000 | 3 |
| 1167001 | 0 |
| 1167002 | 0 |
| 1167003 | 0 |
| 1167004 | 0 |
| 1167024 | 4 |
| 1167025 | 3 |
| 1167026 | 4 |
| 1167027 | 4 |
| 1167050 | 1 |
| 1167051 | 0 |
| 1167053 | 1 |
| 1167054 | 4 |
| 1167055 | 0 |
| 1167056 | 0 |

TABLE 67

Tolerability scores in mice at 700 µg dose

| Compound No. | 3 hr. FOB |
|---|---|
| PBS | 0 |
| 1166738 | 0 |
| 1166739 | 0 |
| 1166740 | 4 |
| 1166742 | 3 |
| 1166746 | 0 |
| 1166747 | 0 |
| 1166748 | 0 |
| 1166784 | 0 |
| 1166785 | 1 |
| 1166786 | 3 |
| 1166787 | 3 |
| 1166793 | 0 |
| 1166794 | 0 |
| 1166795 | 1 |
| 1166797 | 4 |
| 1166798 | 3 |

TABLE 68

Tolerability scores in mice at 700 µg dose

| Compound No. | 3 hr. FOB |
|---|---|
| PBS | 0 |
| 1166799 | 1 |
| 1166802 | 0 |
| 1166803 | 0 |
| 1166804 | 0 |
| 1166805 | 0 |
| 1166806 | 0 |
| 1166807 | 0 |
| 1166808 | 0 |
| 1166867 | 0 |
| 1166877 | 1 |
| 1166878 | 2 |
| 1166885 | 3 |
| 1166886 | 0 |
| 1166887 | 3 |
| 1166888 | 3 |
| 1166890 | 0 |
| 1166893 | 0 |

TABLE 69

Tolerability scores in mice at 700 µg dose

| Compound No. | 3 hr. FOB |
|---|---|
| PBS | 0 |
| 1166894 | 0 |
| 1166895 | 0 |
| 1166896 | 0 |
| 1166897 | 0 |
| 1166898 | 0 |
| 1166899 | 0 |

TABLE 69-continued

Tolerability scores in mice at 700 μg dose

| Compound No. | 3 hr. FOB |
|---|---|
| 1166984 | 0 |
| 1166985 | 0 |
| 1166986 | 0 |
| 1166987 | 0 |
| 1166988 | 0 |
| 1166990 | 0 |

TABLE 70

Tolerability scores in mice at 700 μg dose

| Compound No. | 3 hr. FOB |
|---|---|
| PBS | 0 |
| 1167057 | 0 |
| 1167059 | 1 |
| 1167060 | 1 |
| 1174012 | 2 |
| 1174013 | 3 |
| 1174015 | 0 |
| 1174016 | 0 |
| 1174018 | 0 |
| 1174020 | 4 |
| 1174024 | 3 |
| 1174026 | 0 |
| 1174036 | 3 |
| 1174037 | 2 |

TABLE 71

Tolerability scores in mice at 700 μg dose

| Compound No. | 3 hr. FOB |
|---|---|
| PBS | 0 |
| 1166744 | 3 |
| 1166757 | 4 |
| 1166758 | 3 |
| 1166759 | 1 |
| 1166760 | 3 |
| 1166800 | 1 |
| 1166823 | 2 |
| 1166826 | 3 |
| 1166831 | 2 |
| 1166875 | 0 |
| 1166975 | 4 |
| 1166989 | 0 |

TABLE 72

Tolerability scores in mice at 700 μg dose

| Compound No. | 3 hr. FOB |
|---|---|
| PBS | 0 |
| 1166835 | 0 |
| 1166916 | 3 |
| 1166920 | 2 |
| 1166926 | 1 |
| 1166927 | 2 |
| 1166928 | 1 |
| 1166929 | 0 |
| 1166982 | 2 |

TABLE 73

Tolerability scores in mice at 700 μg dose

| Compound No. | 3 hr. FOB |
|---|---|
| PBS | 0 |
| 1167007 | 2 |
| 1167011 | 1 |
| 1167012 | 3 |
| 1167017 | 2 |
| 1167018 | 1 |
| 1174029 | 4 |

TABLE 74

Tolerability scores in mice at 700 μg dose

| Compound No. | 3 hr. FOB |
|---|---|
| PBS | 0 |
| 1174030 | 3 |
| 1174031 | 3 |
| 1174034 | 1 |
| 1174050 | 3 |
| 1174051 | 3 |
| 1174053 | 1 |
| 1174054 | 1 |
| 1174056 | 4 |
| 1174058 | 3 |
| 1174059 | 0 |
| 1174060 | 0 |
| 1174061 | 2 |
| 1174062 | 3 |
| 1174063 | 3 |
| 1174065 | 1 |
| 1174066 | 1 |

TABLE 75

Tolerability scores in mice at 700 μg dose

| Compound No. | 3 hr. FOB |
|---|---|
| PBS | 0 |
| 1166852 | 1 |

TABLE 76

Tolerability scores in mice at 700 μg dose

| Compound No. | 3 hr. FOB |
|---|---|
| PBS | 0 |
| 1166940 | 2 |
| 1166946 | 2 |
| 1166948 | 2 |

TABLE 77

Tolerability scores in mice at 700 μg dose

| Compound No. | 3 hr. FOB |
|---|---|
| PBS | 0 |
| 1166954 | 0 |
| 1167033 | 0 |
| 1167034 | 1 |
| 1167035 | 1 |
| 1167036 | 2 |
| 1167037 | 2 |
| 1167040 | 2 |

TABLE 78

Tolerability scores in mice at 700 µg dose

| Compound No. | 3 hr. FOB |
|---|---|
| PBS | 0 |
| 1167046 | 1 |
| 1167058 | 1 |

TABLE 79

Tolerability scores in mice at 700 µg dose

| Compound No. | 3 hr. FOB |
|---|---|
| PBS | 0 |
| 1199982 | 1 |
| 1199983 | 1 |
| 1199984 | 1 |

Example 7: Activity of Modified Oligonucleotides Complementary to Human GFAP in Transgenic Mice Modified oligonucleotides described above were tested in human GFAP transgenic mouse model. Transgenic mice (line 73.7) was previously described in Messing A., et al., *Fatal encephalopathy with astrocyte inclusions in GFAP transgenic mice*, Am J Pathos. 1998, 152(2):391-398.

Treatment

The GFAP transgenic mice were divided into groups of 3-4 mice each. Each mouse received a single ICV bolus of 300 µg of modified oligonucleotide. A group of 3-4 mice received PBS as a negative control.

RNA Analysis

One week post treatment, mice were sacrificed and RNA was extracted from cortical brain tissue, and/or spinal cord for RTPCR analysis to measure amount of GFAP RNA using primer probe set RTS38621 ((forward sequence AGTTGCAGTCCTTGACCTG, designated herein as SEQ ID NO: 14; reverse sequence CAGCGCCTCCTGA-TAACTG, designated herein as SEQ ID NO: 15; probe sequence ACGAGTCCCTGGAGAGGCAGATG, designated herein as SEQ ID NO: 16), which is a human specific primer-probe set that recognizes all isoforms of GFAP. Results are presented as percent human GFAP RNA relative to PBS control, normalized to mouse peptidylprolyl isomerase A (PPIA), also known as cyclophilin A. Mouse PPIA was amplified using primer probe set m_cyclo24 (forward sequence TCGCCGCTTGCTGCA, designated herein as SEQ ID NO: 17; reverse sequence ATCGGCCGT-GATGTCGA, designated herein as SEQ ID NO: 18; probe sequence CCATGGTCAACCCCACCGTGTTC, designated herein as SEQ ID NO: 19). In some cases, RTPCR value is not defined for a certain sample, and is labeled N.D. (Not Defined).

As shown in the table below, treatment with modified oligonucleotides resulted in reduction of GFAP RNA in comparison to the PBS control.

TABLE 80

Reduction of human GFAP RNA in transgenic mice

| | GFAP RNA (% control) | |
|---|---|---|
| Compound No. | SPINAL CORD | CORTEX |
| PBS | 100 | 100 |
| 1047198 | 44 | 44 |
| 1047362 | 15 | 21 |
| 1047373 | 10 | 16 |
| 1047374 | 8 | 16 |
| 1047386 | 14 | 19 |
| 1047394 | 48 | 43 |
| 1047429 | N.D. | N.D. |
| 1047448 | 37 | 45 |
| 1047500 | 23 | 26 |
| 1047580 | 12 | 15 |
| 1047582 | 5 | 8 |
| 1047583 | 6 | 9 |
| 1047584 | 6 | 7 |
| 1047585 | 8 | 7 |
| 1047586 | 12 | 11 |
| 1047587 | 13 | 13 |
| 1047589 | 9 | 13 |
| 1047590 | 16 | 16 |
| 1047591 | 14 | 17 |
| 1047610 | 33 | 31 |
| 1048203 | 26 | 27 |
| 1048350 | 28 | 24 |

TABLE 81

Reduction of human GFAP RNA in transgenic mice

| | GFAP RNA (% control) | |
|---|---|---|
| Compound No. | SPINAL CORD | CORTEX |
| PBS | 100 | 100 |
| 1047211 | 71 | 66 |
| 1047225 | 65 | 61 |
| 1047298 | 34 | 27 |
| 1047316 | 29 | 24 |
| 1047402 | 30 | 25 |
| 1047432 | 28 | 29 |
| 1047518 | 49 | 34 |
| 1047522 | 23 | 19 |
| 1047532 | 40 | 30 |
| 1047579 | 27 | 17 |
| 1047581 | 11 | 10 |
| 1047598 | 77 | 50 |
| 1047599 | 21 | 15 |
| 1047601 | 47 | 30 |
| 1047602 | N.D. | N.D. |
| 1047609 | 27 | 18 |
| 1047662 | 34 | 27 |
| 1047679 | 58 | 54 |

TABLE 82

Reduction of human GFAP RNA in transgenic mice

| | GFAP RNA (% control) | |
|---|---|---|
| Compound No. | SPINAL CORD | CORTEX |
| PBS | 100 | 100 |
| 1047711 | 45 | 38 |
| 1047884 | 57 | 62 |
| 1047913 | 75 | 66 |
| 1048027 | 64 | 53 |
| 1048151 | 69 | 64 |
| 1048182 | 14 | 10 |
| 1048201 | 6 | 7 |
| 1048204 | 21 | 18 |

TABLE 82-continued

Reduction of human GFAP RNA in transgenic mice

| | GFAP RNA (% control) | |
|---|---|---|
| Compound No. | SPINAL CORD | CORTEX |
| 1048227 | 42 | 28 |
| 1072855 | N.D. | N.D. |
| 1072856 | N.D. | N.D. |
| 1072857 | 28 | 14 |
| 1072861 | 28 | 23 |
| 1072862 | 53 | 33 |
| 1072863 | 51 | 28 |
| 1072886 | 42 | 26 |
| 1072980 | 40 | 25 |
| 1072986 | 98 | 88 |
| 1073033 | 100 | 80 |
| 1073045 | 36 | 24 |
| 1073060 | 19 | 16 |
| 1073063 | 19 | 15 |
| 1073064 | 29 | 20 |
| 1073065 | 16 | 15 |
| 1073093 | 11 | 8 |

TABLE 83

Reduction of human GFAP RNA in transgenic mice

| | GFAP RNA (% control) | |
|---|---|---|
| Compound No. | SPINAL CORD | CORTEX |
| PBS | 100 | 100 |
| 1103217 | 56 | 43 |
| 1103465 | 31 | 19 |
| 1103502 | 47 | 31 |
| 1103516 | 42 | 27 |
| 1103567 | 23 | 18 |
| 1104093 | 13 | 12 |
| 1104118 | N.D. | N.D. |
| 1104145 | 8 | 6 |
| 1104152 | 27 | 17 |
| 1104166 | 17 | 13 |
| 1104175 | 15 | 8 |

TABLE 84

Reduction of human GFAP RNA in transgenic mice

| | GFAP RNA (% control) | |
|---|---|---|
| Compound No. | SPINAL CORD | CORTEX |
| PBS | 100 | 100 |
| 1072813 | 15 | 18 |
| 1072814 | 15 | 19 |
| 1103202 | 34 | 36 |
| 1103218 | 48 | 33 |
| 1103253 | 56 | 36 |
| 1103255 | N.D. | N.D. |
| 1103256 | 35 | 41 |
| 1103257 | 46 | 43 |
| 1103258 | N.D. | N.D. |
| 1103259 | 82 | 71 |
| 1103268 | N.D. | N.D. |
| 1104307 | 13 | 14 |
| 1104309 | 10 | 11 |
| 1104311 | 11 | 18 |
| 1104349 | N.D. | N.D. |

TABLE 85

Reduction of human GFAP RNA in transgenic mice

| | GFAP RNA (% control) | |
|---|---|---|
| Compound No. | SPINAL CORD | CORTEX |
| PBS | 100 | 100 |
| 1103279 | 20 | 14 |
| 1103285 | 16 | 9 |
| 1103411 | 65 | 32 |
| 1103471 | 32 | 39 |
| 1103570 | 6 | 4 |
| 1103872 | 42 | 18 |
| 1104116 | 6 | 3 |
| 1104127 | 15 | 10 |
| 1104144 | 17 | 8 |
| 1104159 | 17 | 10 |
| 1104276 | 53 | 41 |
| 1166719 | 41 | 31 |
| 1166720 | 12 | 8 |
| 1166721 | 7 | 8 |
| 1166749 | 13 | 11 |
| 1166750 | 10 | 7 |
| 1166751 | 12 | 9 |
| 1166761 | 12 | 5 |

TABLE 86

Reduction of human GFAP RNA in transgenic mice

| Compound No. | GFAP RNA (% control) CORTEX |
|---|---|
| PBS | 100 |
| 1166762 | 18 |
| 1166763 | 13 |
| 1166775 | 21 |
| 1166776 | 30 |
| 1166777 | 13 |
| 1166778 | 6 |
| 1166779 | 7 |
| 1166780 | 9 |
| 1166781 | 7 |
| 1166782 | 12 |
| 1166783 | 17 |
| 1166809 | 13 |
| 1166810 | 16 |
| 1166812 | 23 |
| 1166813 | 21 |
| 1166814 | 29 |
| 1166815 | 42 |
| 1166816 | 31 |
| 1166817 | 37 |
| 1166818 | 14 |
| 1166819 | 9 |
| 1166820 | 12 |
| 1166821 | 15 |
| 1166822 | 20 |
| 1166841 | 47 |

TABLE 87

Reduction of human GFAP RNA in transgenic mice

| | GFAP RNA (% control) | |
|---|---|---|
| Compound No. | SPINAL CORD | CORTEX |
| PBS | 100 | 100 |
| 1166842 | 19 | 14 |
| 1166843 | 37 | 21 |
| 1166845 | 17 | 19 |
| 1166846 | 12 | 18 |
| 1166847 | 13 | 19 |

TABLE 87-continued

Reduction of human GFAP RNA in transgenic mice

| Compound No. | GFAP RNA (% control) SPINAL CORD | CORTEX |
|---|---|---|
| 1166869 | 10 | 11 |
| 1166870 | 6 | 7 |
| 1166871 | 5 | 7 |
| 1166872 | 10 | 9 |
| 1166873 | 14 | 14 |
| 1166874 | 9 | 10 |
| 1166900 | 14 | 20 |
| 1166901 | 11 | 13 |
| 1166902 | 12 | 15 |
| 1166903 | 17 | 19 |
| 1166904 | 26 | 30 |
| 1166905 | 24 | 28 |
| 1166906 | 50 | 56 |
| 1166907 | 28 | 32 |

TABLE 88

Reduction of human GFAP RNA in transgenic mice

| Compound No. | GFAP RNA (% control) CORTEX |
|---|---|
| PBS | 100 |
| 1166909 | 30 |
| 1166910 | 8 |
| 1166911 | 7 |
| 1166912 | 15 |
| 1166913 | 12 |
| 1166932 | 41 |
| 1166933 | 13 |
| 1166934 | 18 |
| 1166991 | 14 |
| 1166992 | 11 |
| 1166993 | 9 |
| 1166994 | 10 |
| 1166996 | 21 |
| 1166997 | 30 |
| 1166998 | 13 |
| 1166999 | 11 |
| 1167000 | 15 |

TABLE 89

Reduction of human GFAP RNA in transgenic mice

| Compound No. | GFAP RNA (% control) CORTEX |
|---|---|
| PBS | 100 |
| 1167001 | 9 |
| 1167002 | 7 |
| 1167003 | 8 |
| 1167004 | 13 |
| 1167024 | 18 |
| 1167025 | 11 |
| 1167026 | 14 |
| 1167027 | 13 |
| 1167050 | 11 |
| 1167051 | 10 |
| 1167053 | 7 |
| 1167054 | 5 |
| 1167055 | 6 |
| 1167056 | 6 |

TABLE 90

Reduction of human GFAP RNA in transgenic mice

| Compound No. | GFAP RNA (% control) CORTEX |
|---|---|
| PBS | 100 |
| 1166738 | 27 |
| 1166739 | 27 |
| 1166740 | 26 |
| 1166742 | 43 |
| 1166746 | 94 |
| 1166747 | 23 |
| 1166748 | 20 |
| 1166784 | 30 |
| 1166785 | 13 |
| 1166786 | 19 |
| 1166787 | 19 |
| 1166793 | 23 |
| 1166794 | 32 |
| 1166795 | 51 |
| 1166798 | 25 |
| 1166799 | 33 |
| 1166802 | 38 |
| 1166803 | 31 |
| 1166804 | 29 |
| 1166805 | 7 |
| 1166806 | 23 |
| 1166807 | 19 |
| 1166808 | 14 |
| 1166867 | 13 |
| 1166877 | 7 |
| 1166878 | 13 |
| 1166885 | 20 |
| 1166886 | 25 |

TABLE 91

Reduction of human GFAP RNA in transgenic mice

| Compound No. | GFAP RNA (% control) CORTEX |
|---|---|
| PBS | 100 |
| 1166887 | 12 |
| 1166888 | 16 |
| 1166890 | 38 |
| 1166893 | 39 |
| 1166894 | 20 |
| 1166895 | 11 |
| 1166896 | 8 |
| 1166897 | 6 |
| 1166898 | 8 |
| 1166899 | 11 |
| 1166984 | 24 |
| 1166985 | 9 |
| 1166986 | 13 |
| 1166987 | 7 |
| 1166988 | 5 |
| 1166990 | 9 |
| 1167057 | 7 |
| 1167059 | 5 |
| 1167060 | 8 |
| 1174012 | 9 |
| 1174013 | 33 |
| 1174015 | 107 |

TABLE 92

Reduction of human GFAP RNA in transgenic mice

| Compound No. | GFAP RNA (% control) CORTEX |
|---|---|
| PBS | 100 |
| 1166744 | 14 |
| 1166757 | 7 |
| 1166758 | 34 |
| 1166759 | 9 |
| 1166760 | 16 |
| 1166800 | 8 |
| 1166823 | 7 |
| 1166826 | 6 |
| 1166831 | 16 |
| 1166835 | 47 |
| 1166875 | 7 |
| 1166916 | 14 |
| 1166920 | 18 |
| 1166975 | 6 |
| 1166989 | 4 |
| 1174016 | 66 |
| 1174018 | 11 |
| 1174020 | 12 |
| 1174024 | 52 |
| 1174026 | 7 |
| 1174036 | 43 |
| 1174037 | 24 |

TABLE 93

Reduction of human GFAP RNA in transgenic mice

| Compound No. | GFAP RNA (% control) CORTEX |
|---|---|
| PBS | 100 |
| 1166926 | 14 |
| 1166927 | 15 |
| 1166928 | 13 |
| 1166929 | 15 |
| 1166982 | 11 |
| 1167007 | 44 |
| 1167011 | 21 |
| 1167012 | 23 |
| 1167017 | 8 |
| 1167018 | 11 |
| 1174029 | 32 |
| 1174030 | 75 |
| 1174031 | 35 |
| 1174034 | 17 |
| 1174050 | 10 |
| 1174051 | 15 |
| 1174053 | 22 |
| 1174054 | 40 |
| 1174056 | 7 |
| 1174058 | 14 |
| 1174059 | 14 |
| 1174060 | 19 |
| 1174061 | 17 |
| 1174062 | 12 |
| 1174063 | 12 |

TABLE 94

Reduction of human GFAP RNA in transgenic mice

| Compound No. | GFAP RNA (% control) CORTEX |
|---|---|
| PBS | 100 |
| 1166852 | 15 |
| 1166940 | 16 |
| 1166946 | 34 |
| 1166948 | 41 |
| 1166954 | 16 |
| 1167033 | 9 |
| 1167034 | 11 |
| 1167035 | 15 |
| 1167036 | 19 |
| 1167037 | 25 |
| 1167040 | 15 |

TABLE 95

Reduction of human GFAP RNA in transgenic mice

| Compound No. | GFAP RNA (% control) CORTEX |
|---|---|
| PBS | 100 |
| 1167046 | 14 |
| 1167058 | 5 |
| 1174065 | 10 |
| 1174066 | 13 |
| 1199982 | 4 |
| 1199983 | 13 |
| 1199984 | 16 |

Example 8: Tolerability of Modified Oligonucleotides Complementary to Human GFAP in Rats, 3 mg Dose Modified oligonucleotides described above were tested in rats to assess the tolerability of the oligonucleotides. Sprague Dawley rats each received a single intrathecal (IT) dose of 3 mg of oligonucleotide listed in the table below. Each treatment group consisted of 2-4 rats. A group of 2-4 rats received PBS as a negative control. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Results are presented as the average score for each treatment group.

TABLE 96

Tolerability scores in rats at 3 mg dose

| Compound No. | FOB 3 hr |
|---|---|
| PBS | 0 |
| 1047198 | 4 |

TABLE 96-continued

Tolerability scores in rats at 3 mg dose

| Compound No. | FOB 3 hr |
|---|---|
| 1047362 | 3 |
| 1047386 | 5 |
| 1047580 | 2 |
| 1047583 | 1 |
| 1047584 | 2 |
| 1047585 | 0 |
| 1047586 | 0 |
| 1047587 | 0 |
| 1047589 | 2 |
| 1047590 | 2 |
| 1047591 | 4 |
| 1048350 | 3 |

TABLE 97

Tolerability scores in rats at 3 mg dose

| Compound No. | FOB 3 hr |
|---|---|
| PBS | 0 |
| 1047429 | 2 |
| 1047448 | 1 |
| 1047500 | 3 |
| 1047581 | 2 |
| 1047599 | 2 |
| 1047609 | 5 |
| 1047913 | 4 |
| 1048027 | 3 |
| 1048151 | 2 |

TABLE 98

Tolerability scores in rats at 3 mg dose

| Compound No. | FOB 3 hr |
|---|---|
| PBS | 0 |
| 1047316 | 4 |
| 1047402 | 3 |
| 1047522 | 0 |
| 1047532 | 3 |
| 1047579 | 4 |
| 1048201 | 2 |
| 1048204 | 0 |

TABLE 99

Tolerability scores in rats at 3 mg dose

| Compound No. | FOB 3 hr |
|---|---|
| PBS | 0 |
| 1047298 | 3 |
| 1072813 | 0 |
| 1072814 | 4 |
| 1072855 | 4 |
| 1072857 | 4 |
| 1104116 | 0 |
| 1104145 | 2 |
| 1104175 | 4 |
| 1166721 | 0 |
| 1166750 | 4 |
| 1166751 | 4 |
| 1166871 | 2 |

TABLE 100

Tolerability scores in rats at 3 mg dose

| Compound No. | FOB 3 hr |
|---|---|
| PBS | 0 |
| 1166720 | 1 |
| 1166775 | 2 |
| 1166778 | 2 |
| 1166780 | 2 |
| 1166781 | 1 |
| 1166782 | 1 |
| 1166783 | 1 |
| 1166819 | 2 |
| 1166820 | 3 |
| 1166821 | 3 |
| 1166842 | 4 |
| 1166869 | 2 |
| 1166872 | 2 |
| 1166873 | 0 |
| 1166874 | 0 |

TABLE 101

Tolerability scores in rats at 3 mg dose

| Compound No. | FOB 3 hr |
|---|---|
| PBS | 0 |
| 1166748 | 0 |
| 1166785 | 2 |
| 1166793 | 1 |
| 1166805 | 1 |
| 1166806 | 2 |
| 1166807 | 0 |
| 1166910 | 3 |
| 1166911 | 2 |
| 1166912 | 3 |
| 1166933 | 3 |
| 1166998 | 2 |
| 1167050 | 4 |
| 1167053 | 3 |
| 1167055 | 2 |
| 1167056 | 1 |

TABLE 102

Tolerability scores in rats at 3 mg dose

| Compound No. | FOB 3 hr |
|---|---|
| PBS | 0 |
| 1166808 | 0 |
| 1166867 | 1 |
| 1166877 | 2 |
| 1166878 | 3 |
| 1166894 | 1 |
| 1166895 | 0 |
| 1166896 | 2 |
| 1166897 | 2 |
| 1166898 | 0 |
| 1166899 | 0 |
| 1166985 | 0 |
| 1166990 | 0 |

TABLE 103

Tolerability scores in rats at 3 mg dose

| Compound No. | FOB 3 hr |
|---|---|
| PBS | 0 |
| 1166759 | 2 |
| 1166760 | 2 |
| 1166800 | 3 |
| 1166823 | 4 |
| 1166831 | 5 |
| 1166875 | 1 |
| 1166920 | 3 |
| 1166926 | 2 |
| 1166927 | 2 |
| 1166928 | 2 |
| 1166982 | 3 |
| 1166986 | 1 |
| 1166987 | 1 |
| 1166988 | 5 |
| 1166989 | 1 |
| 1167001 | 3 |

TABLE 104

Tolerability scores in rats at 3 mg dose

| Compound No. | FOB 3 hr |
|---|---|
| PBS | 0 |
| 1167002 | 2 |
| 1167003 | 3 |
| 1167017 | 3 |
| 1167018 | 3 |
| 1167057 | 1 |
| 1167059 | 2 |
| 1167060 | 2 |
| 1174012 | 3 |
| 1174018 | 1 |
| 1174026 | 2 |
| 1174034 | 3 |
| 1174059 | 1 |
| 1174060 | 1 |
| 1174061 | 4 |

TABLE 105

Tolerability scores in rats at 3 mg dose

| Compound No. | FOB 3 hr |
|---|---|
| PBS | 0 |
| 1166852 | 3 |
| 1166940 | 2 |
| 1166946 | 2 |
| 1166948 | 3 |
| 1166954 | 2 |

TABLE 106

Tolerability scores in rats at 3 mg dose

| Compound No. | FOB 3 hr |
|---|---|
| PBS | 0 |
| 1167033 | 4 |
| 1167034 | 3 |
| 1167035 | 3 |
| 1167036 | 2 |
| 1167037 | 2 |

TABLE 106-continued

Tolerability scores in rats at 3 mg dose

| Compound No. | FOB 3 hr |
|---|---|
| 1167040 | 3 |
| 1167046 | 3 |
| 1167058 | 2 |

TABLE 107

Tolerability scores in rats at 3 mg dose

| Compound No. | FOB 3 hr |
|---|---|
| PBS | 0 |
| 1174065 | 1 |
| 1174066 | 2 |
| 1199982 | 1 |
| 1199983 | 1 |
| 1199984 | 2 |

Example 9: Potency of Modified Oligonucleotides Complementary to Human GFAP in Transgenic Mice Modified oligonucleotides described above were tested in human GFAP transgenic mouse model. Transgenic mice (line 73.7) was previously described in Messing A., et al., Fatal encephalopathy with astrocyte inclusions in GFAP transgenic mice, *Am J Pathos.* 1998, 152(2):391-398.

Treatment

The GFAP transgenic mice were divided into groups of 4 mice each. Each mouse received a single ICV bolus of modified oligonucleotide at the doses indicated in tables below. A group of 4-8 mice received PBS as a negative control.

RNA Analysis

Two weeks post treatment, mice were sacrificed, and RNA was extracted from the cortex, spinal cord, and brainstem for RTPCR analysis of RNA expression of GFAP using primer probe set RTS38621, described in Example 6 above. Results are presented as percent change of RNA, relative to PBS control, normalized to mouse PPIA. The half maximal effective dose ($ED_{50}$) of each modified oligonucleotide was calculated using GraphPad Prism 6 software (GraphPad Software, San Diego, Calif.). $ED_{50}$ values were calculated from dose and individual animal GFAP mRNA levels using custom equation Motulsky: Agonist vs response–Variable slope (four parameters) Y=Bottom+(Top−Bottom)/(1+(10^log EC50/X)^HillSlope), with the following constraints: bottom>lowest value in data set in order to compare across ASOs (3, 5, and 3 for cortex, spinal cord, and brainstem, respectively), top=100, HillSlope<−1 and >−2.

As shown in the table below, treatment with modified oligonucleotides resulted in dose-responsive reduction of GFAP RNA in comparison to the PBS control.

TABLE 108

Reduction of human GFAP RNA (all isoforms) in transgenic mice

| Compound No. | Dose (μg) | GFAP RNA (% control) CORTEX | $ED_{50}$ (μg) |
|---|---|---|---|
| PBS | N/A | 100 | N/A |
| 1104145 | 1 | 77 | 8 |
|  | 3 | 74 |  |
|  | 10 | 53 |  |
|  | 30 | 19 |  |
|  | 100 | 8 |  |

TABLE 109

Reduction of human GFAP RNA (all isoforms) in transgenic mice

| Compound No. | Dose (μg) | GFAP RNA (% control) | | | $ED_{50}$ (μg) | | |
|---|---|---|---|---|---|---|---|
| | | CORTEX | SPINAL CORD | BRAIN STEM | CORTEX | SPINAL CORD | BRAIN STEM |
| PBS | N/A | 100 | 100 | 100 | N/A | N/A | N/A |
| 1072813 | 3 | 93 | 101 | 99 | 34 | 24 | 21 |
|  | 10 | 68 | 71 | 69 |  |  |  |
|  | 30 | 70 | 38 | 37 |  |  |  |
|  | 100 | 18 | 28 | 21 |  |  |  |
|  | 300 | 10 | 19 | 13 |  |  |  |
| 1166721 | 1 | 116 | 111 | 94 | 25 | 25 | 12 |
|  | 3 | 95 | 104 | 89 |  |  |  |
|  | 10 | 91 | 73 | 51 |  |  |  |
|  | 30 | 39 | 47 | 28 |  |  |  |
|  | 100 | 13 | 18 | 11 |  |  |  |
|  | 300 | 7 | 10 | 6 |  |  |  |
| 1166874 | 1 | 81 | 102 | 78 | 27 | 11 | 7 |
|  | 3 | 73 | 83 | 75 |  |  |  |
|  | 10 | 77 | 50 | 45 |  |  |  |
|  | 30 | 65 | 32 | 22 |  |  |  |
|  | 100 | 12 | 14 | 10 |  |  |  |
|  | 300 | 5 | 9 | 6 |  |  |  |
| 1166895 | 3 | 108 | 93 | 93 | 41 | 93 | 38 |
|  | 10 | 82 | 94 | 80 |  |  |  |
|  | 30 | 46 | 74 | 50 |  |  |  |
|  | 100 | 40 | 40 | 32 |  |  |  |

TABLE 110

Reduction of human GFAP RNA (all isoforms) in transgenic mice

| Compound No. | Dose (μg) | GFAP RNA (% control) | | | ED50 (μg) | | |
|---|---|---|---|---|---|---|---|
| | | CORTEX | SPINAL CORD | BRAIN STEM | CORTEX | SPINAL CORD | BRAIN STEM |
| PBS | N/A | 100 | 100 | 100 | N/A | N/A | N/A |
| 1166895 | 300 | 16 | 45 | 27 | N/A | N/A | N/A |
| 1166926 | 3 | 103 | 77 | 77 | 47 | 32 | 17 |
|  | 10 | 86 | 70 | 57 |  |  |  |
|  | 30 | 67 | 62 | 49 |  |  |  |
|  | 100 | 27 | 27 | 20 |  |  |  |
|  | 300 | 13 | 21 | 11 |  |  |  |
| 1166985 | 1 | 105 | 101 | 100 | 46 | 36 | 14 |
|  | 3 | 96 | 90 | 78 |  |  |  |
|  | 10 | 75 | 68 | 53 |  |  |  |
|  | 30 | 79 | 58 | 40 |  |  |  |
|  | 100 | 17 | 35 | 15 |  |  |  |
|  | 300 | 8 | 23 | 10 |  |  |  |
| 1167056 | 1 | 102 | 87 | 86 | 10 | 5 | 3 |
|  | 3 | 81 | 60 | 42 |  |  |  |
|  | 10 | 54 | 35 | 20 |  |  |  |
|  | 30 | 20 | 16 | 9 |  |  |  |
|  | 100 | 5 | 8 | 5 |  |  |  |
|  | 300 | 3 | 7 | 4 |  |  |  |

TABLE 110-continued

Reduction of human GFAP RNA (all isoforms) in transgenic mice

| Compound No. | Dose (μg) | GFAP RNA (% control) | | | ED50 (μg) | | |
|---|---|---|---|---|---|---|---|
| | | CORTEX | SPINAL CORD | BRAIN STEM | CORTEX | SPINAL CORD | BRAIN STEM |
| 1167058 | 1 | 98 | 82 | 80 | 19 | 4 | 3 |
| | 3 | 79 | 59 | 44 | | | |
| | 10 | 79 | 21 | 20 | | | |

TABLE 111

Reduction of human GFAP RNA (all isoforms) in transgenic mice

| Compound No. | Dose (μg) | GFAP RNA (% control) | | | ED50 (μg) | | |
|---|---|---|---|---|---|---|---|
| | | CORTEX | SPINAL CORD | BRAIN STEM | CORTEX | SPINAL CORD | BRAIN STEM |
| PBS | N/A | 100 | 100 | 100 | N/A | N/A | N/A |
| 1166927 | 3 | 91 | 92 | 89 | 44 | 24 | 15 |
| | 10 | 98 | 62 | 57 | | | |
| | 30 | 62 | 52 | 35 | | | |
| | 100 | 25 | 26 | 14 | | | |
| | 300 | 14 | 20 | 12 | | | |
| 1166954 | 3 | 106 | 87 | 85 | 58 | 60 | 26 |
| | 10 | 79 | 80 | 68 | | | |
| | 30 | 70 | 65 | 49 | | | |
| | 100 | 36 | 46 | 27 | | | |
| | 300 | 20 | 25 | 17 | | | |
| 1166986 | 3 | 114 | 113 | 101 | 35 | 42 | 21 |
| | 10 | 87 | 88 | 66 | | | |
| | 30 | 52 | 56 | 38 | | | |
| | 100 | 23 | 30 | 20 | | | |
| | 300 | 10 | 20 | 14 | | | |
| 1166998 | 3 | 77 | 73 | 61 | 23 | 13 | 6 |
| | 10 | 90 | 63 | 42 | | | |
| | 30 | 36 | 31 | 20 | | | |
| 1167058 | 30 | 34 | 14 | 9 | N/A | N/A | N/A |
| | 100 | 9 | 7 | 6 | | | |
| | 300 | 5 | 6 | 4 | | | |

TABLE 112

Reduction of human GFAP RNA (all isoforms) in transgenic mice

| Compound No. | Dose (μg) | GFAP RNA (% control) RTS38621 | | | ED50 (μg) | | |
|---|---|---|---|---|---|---|---|
| | | CORTEX | SPINAL CORD | BRAIN STEM | CORTEX | SPINAL CORD | BRAIN STEM |
| PBS | | 100 | 100 | 100 | N/A | N/A | N/A |
| 1166998 | 100 | 11 | 18 | 17 | N/A | N/A | N/A |
| | 300 | 7 | 12 | 9 | N/A | N/A | N/A |
| 1199983 | 3 | 75 | 83 | 71 | 18 | 16 | 15 |
| | 10 | 72 | 57 | 62 | | | |
| | 30 | 37 | 38 | 38 | | | |
| | 100 | 17 | 27 | 22 | | | |
| | 300 | 12 | 22 | 17 | | | |

Example 10: Effect of Modified Oligonucleotides on Human GFAP RNA In Vitro, Multiple Doses Modified oligonucleotides selected from the examples above were tested at various doses in U251 cells. Cultured U251 cells at a density of 30,000 cells per well were treated with electroporation with various concentrations of modified oligonucleotide as specified in the tables below. After a treatment period of approximately 24 hours, total RNA was isolated from the cells and GFAP RNA levels were measured by quantitative real-time RTPCR. Human GFAP primer probe sets RTS38621 (described herein above), RTS38624 (forward sequence AACCGGATCACCATTCCC, designated herein as SEQ ID NO:2892; reverse sequence CCTTGTGATTTTCCCCGTCT, designated herein as SEQ ID NO: 1064; probe sequence TGCTTTTGCCCCCTCGAATCTG, designated herein as SEQ ID NO: 2894), and RTS38622 (forward sequence AACCGGATCACCATTCCC, designated herein as SEQ ID NO: 2892; reverse sequence GTCTTCACCAC- GATGTTCCTC, designated herein as SEQ ID NO: 2896; probe sequence CACCAAGTCTGTGTCAGAAGGCCA, designated herein as SEQ ID NO: 2897) were used to measure RNA levels. GFAP RNA levels were normalized to total GAPDH, as measured by human primer probe set RTS104 (forward sequence GAAGGTGAAGGTCG-GAGTC, designated herein as SEQ ID NO: 2898; reverse sequence GAAGATGGTGATGGGATTTC, designated herein as SEQ ID NO: 2899; probe sequence CAAGCTTCCCGTTCTCAGCC, designated herein as SEQ ID NO: 2900). Results are presented as percent of GFAP RNA, relative to untreated control cells (% UTC). The half maximal inhibitory concentration ($IC_{50}$) of each modified oligonucleotide was calculated using a linear regression on a log/linear plot of the data in Excel.

TABLE 113

Dose-dependent reduction of human GFAP RNA in U251 cells by modified oligonucleotides

| Compound No. | GFAP RNA (% UTC) RTS38621 | | | | | $IC_{50}$ (μM) |
|---|---|---|---|---|---|---|
| | 123 nM | 370 nM | 1100 nM | 3300 nM | 10000 nM | |
| 1072813 | 111 | 77 | 62 | 28 | 16 | 1.6 |
| 1166721 | 81 | 63 | 30 | 19 | 15 | 0.6 |
| 1166874 | 86 | 62 | 34 | 15 | 15 | 0.6 |
| 1166895 | 91 | 94 | 68 | 40 | 21 | 2.5 |
| 1166954 | 69 | 52 | 35 | 14 | 12 | 0.4 |
| 1047582 | 54 | 26 | 13 | 6 | 5 | 0.1 |

TABLE 114

Dose-dependent reduction of human GFAP RNA in U251 cells by modified oligonucleotides

| Compound No. | GFAP RNA (% UTC) RTS38622 | | | | | $IC_{50}$ (μM) |
|---|---|---|---|---|---|---|
| | 123 nM | 370 nM | 1100 nM | 3300 nM | 10000 nM | |
| 1072813 | 84 | 70 | 34 | 20 | 9 | 0.7 |
| 1166721 | 78 | 47 | 27 | 15 | 11 | 0.4 |
| 1166874 | 80 | 49 | 27 | 9 | 7 | 0.4 |
| 1166895 | 89 | 83 | 62 | 35 | 17 | 1.8 |
| 1166954 | 68 | 50 | 27 | 9 | 5 | 0.3 |
| 1047582 | 51 | 24 | 10 | 3 | 1 | 0.1 |

TABLE 115

Dose-dependent reduction of human GFAP RNA in U251 cells by modified oligonucleotides

| Compound No. | GFAP RNA (% UTC) RTS38624 | | | | | $IC_{50}$ (μM) |
|---|---|---|---|---|---|---|
| | 123 nM | 370 nM | 1100 nM | 3300 nM | 10000 nM | |
| 1072813 | 98 | 86 | 78 | 61 | 54 | 10.6 |
| 1166721 | 87 | 66 | 43 | 28 | 21 | 1.0 |
| 1166874 | 70 | 90 | 57 | 50 | 54 | 9.0 |
| 1166895 | 88 | 90 | 71 | 52 | 34 | 4.0 |
| 1166954 | 77 | 69 | 67 | 53 | 50 | 6.9 |
| 1047582 | 68 | 56 | 47 | 41 | 43 | 1.2 |

TABLE 116

Dose-dependent reduction of human GFAP RNA in U251 cells by modified oligonucleotides

| Compound No. | GFAP RNA (% UTC) RTS38621 | | | | | $IC_{50}$ (μM) |
|---|---|---|---|---|---|---|
| | 123 nM | 370 nM | 1100 nM | 3300 nM | 10000 nM | |
| 1166985 | 88 | 79 | 49 | 33 | 18 | 1.3 |
| 1166986 | 82 | 71 | 55 | 31 | 23 | 1.3 |
| 1166998 | 74 | 97 | 37 | 23 | 15 | 1.1 |
| 1167056 | 64 | 38 | 23 | 12 | 10 | 0.2 |
| 1199983 | 70 | 53 | 37 | 17 | 10 | 0.4 |
| 1048182 | 69 | 53 | 30 | 15 | 10 | 0.4 |

TABLE 117

Dose-dependent reduction of human GFAP RNA in U251 cells by modified oligonucleotides

| Compound No. | GFAP RNA (% UTC) RTS38622 | | | | | IC$_{50}$ (µM) |
|---|---|---|---|---|---|---|
| | 123 nM | 370 nM | 1100 nM | 3300 nM | 10000 nM | |
| 1166985 | 79 | 71 | 44 | 28 | 16 | 0.9 |
| 1166986 | 83 | 68 | 53 | 30 | 23 | 1.2 |
| 1166998 | 72 | 94 | 37 | 23 | 15 | 1.0 |
| 1167056 | 64 | 38 | 21 | 9 | 6 | 0.2 |
| 1199983 | 72 | 62 | 40 | 18 | 11 | 0.6 |
| 1048182 | 79 | 50 | 36 | 19 | 13 | 0.5 |

TABLE 118

Dose-dependent reduction of human GFAP RNA in U251 cells by modified oligonucleotides

| Compound No. | GFAP RNA (% UTC) RTS38624 | | | | | IC$_{50}$ (µM) |
|---|---|---|---|---|---|---|
| | 123 nM | 370 nM | 1100 nM | 3300 nM | 10000 nM | |
| 1166985 | 80 | 75 | 54 | 44 | 25 | 1.8 |
| 1166986 | 86 | 73 | 65 | 43 | 31 | 2.5 |
| 1166998 | 76 | 111 | 53 | 32 | 17 | 1.8 |
| 1167056 | 80 | 72 | 62 | 53 | 55 | 10.6 |
| 1199983 | 77 | 65 | 52 | 31 | 20 | 1.0 |
| 1048182 | 92 | 69 | 52 | 33 | 20 | 1.3 |

Example 11: Effect of Modified Oligonucleotides on Human GFAP RNA In Vitro, Multiple Doses Modified oligonucleotides selected from the examples above were tested at various doses in U251 cells. Cultured U251 cells at a density of 20,000 cells per well were treated using free uptake with various concentrations of modified oligonucleotide as specified in the tables below. After a treatment period of approximately 48 hours, total RNA was isolated from the cells and GFAP RNA levels were measured by quantitative real-time RTPCR. Human GFAP primer probe sets RTS37485 (described herein above) was used to measure RNA levels. GFAP RNA levels were normalized to total GAPDH, as measured by human primer probe set RTS104 (described herein above). Results are presented as percent of GFAP RNA, relative to untreated control cells (% UTC). The half maximal inhibitory concentration (IC$_{50}$) of each modified oligonucleotide was calculated using a linear regression on a log/linear plot of the data in Excel.

TABLE 113

Dose-dependent reduction of human GFAP RNA in U251 cells by modified oligonucleotides

| Compound No. | GFAP RNA (% UTC) RTS37485 | | | | | IC$_{50}$ (µM) |
|---|---|---|---|---|---|---|
| | 250 nM | 740 nM | 2220 nM | 6670 nM | 20000 nM | |
| 1072813 | 105 | 102 | 80 | 59 | 34 | 10 |
| 1166721 | 92 | 83 | 64 | 49 | 32 | 7 |
| 1166874 | 81 | 78 | 55 | 38 | 22 | 4 |
| 1166895 | 83 | 89 | 85 | 78 | 73 | 950 |
| 1166926 | 97 | 93 | 79 | 73 | 58 | 31 |
| 1166927 | 89 | 86 | 78 | 76 | 52 | 28 |
| 1166954 | 92 | 90 | 77 | 67 | 58 | 29 |
| 1166985 | 104 | 108 | 104 | 94 | 80 | 43 |
| 1166986 | 94 | 92 | 95 | 84 | 82 | 1063 |
| 1166998 | 91 | 91 | 77 | 59 | 42 | 12 |
| 1167056 | 77 | 55 | 32 | 17 | 12 | 1 |
| 1167058 | 85 | 59 | 41 | 18 | 15 | 1 |
| 1199983 | 94 | 88 | 73 | 62 | 49 | 17 |

SEQUENCE LISTING (2900 sequences)

SEQ ID NO: 1 - DNA, 3097 bp, Homo sapiens
atcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccaaaaaaaaaaaa

SEQ ID NO: 2 - DNA, 16000 bp, Homo sapiens
aaatctggtagtgtttatctccaggtggcaaaatgatggctaattacatttttttgtattgcttatctatagtttctgacctttctacaatgaatatttaattaaaaagataatgaaagtttggaacacaaccacgaccaaatctgtctgtatctttggttctctgtgcagacacctttagatagttaagggttggccaggcgtgatctatatgtaccggttgtataggtcatgcctgtaatcccagcactttgggaggaagaggtgggagggtcacttgagcccaacagttcgagaccagcctgggcaacatggcgaaaccttgtctctagtaaaatacaaaaatgagctgggcatggtggtgtatctctgtggtcccagctactagagaggctgaggtgggtggatcgcttgagccagggagattgaggctgtagtgagctgtgatagcaccacttcactctagcctgggcaacagagcaagaccctgtctcaaaaaacaaaaacaagatagttaagggttgagtgtgaggaaaggtctgagggttgagaaggggtggaggatgcacctgggcctatgacaggggtccacggaggtggctgatggcaaaagctgggggactccaactgctgatgctgaaacaagcttgtgtctcacatacacagggacagttcactgagcttcaatgacaggcacctcctgctcatcacatcttttctctctaggacagctttgcccttattttaactagacttcccttgaaccaaaagggaaggctacatgctgtgacttgctgggcagcctggaaaggcgggccactcctagccacagagatgagacagagttcagacaagagcttatccccagtcttccttttctattttgtttattttattttatttttttatttattgagacagagtctctgtcacccaggctggggtgcagtgatgcgacattggcttactgcagtctccacctcctgggctcaggtgatcctcccacctcagcctcccgaatagctgggatcacagtagtgcaccaccatacctggctaatttttttgtattttttgtacagacaaaatttcaccacattgcccaggctggtctcgaactcctggactcaagcgatccgcccacctcagcctcccaaagtgctcggattacaggcatgagccactatgcccagccttgctcttcctttaaagcctcctgtccttccccaggtccccagttcatagcaggatcaaaggtcactgggcgctcaccccgtcttcaagatgctctttcctatgtcactgcttacgcccaggtcagatgtgactagagcctaaggagctcccacctccctctctgtgctgggactcacagagggagacctcaggaggcagtctgtccatcacatgtccaaatgcagagcataccctgggctgggcgcagtggcgcacaactgtaattccagcactttgggaggctgatgtggaaggatcacttgagcccagaagttctagaccagcctgggcaacatggcaagaccctatctctacaaaaaaagttaaaaaatcagccacgtgtggtgacacacacctgtagtcccagctattcaggaggctgaggtgaggggatcacttaaggctgggaggttgaggctgcagtgagtcgtggttgcgccactgcactccagcctgggcaacagtgagaccctgtctcaaaagacaaaaaaaaaaaaaaaaaaaaaaagaacatatcctggtgtggagtaggggacgctgctctgacagaggctcgggggcctgagctggctctgtgagctggggaggaggcagacagccaggccttgtctgcaagcagacctggcagcattgggctggccgccccccagggcctcctcttcatgcccagtgaatgactcaccttggcacagacacaatgttcggggtgggcacagtgcctgcttcccgccgcaccccagcccccctcaaatgccttccgagaagcccattgagcagggggcttgcattgcaccccagcctgacagcctggcatcttgggataaaagcagcacagccccctaggggctgcccttgctgtgtggcgccaccggcggtggagaacaaggctctattcagcctgtgcccaggaaaggggatcaggggatgcccaggcatggacagtgggtggcagggggggagaggagggctgtctgcttcccagaagtccaaggacacaaatgggtgaggggactgggcagggttctgaccctgtgggaccagagtggagggcgtagatggacctgaagtctccagggacaacagggcccaggtctcaggctcctagttgggcccagtggctccagcgtttccaaacccatccatccccagaggttcttcccatctctccaggctgatgtgtgggaactcgaggaaataaatctccagtgggagacggaggggtggccagggaaacggggcgctgcaggaataaagacgagccagcacagccagctcatgtgtaacggctttgtggagctgtcaaggcctggtctctgggagagaggcacagggaggccagacaaggaaggggtgacctggagggacagatccaggggctaaagtcctgataaggcaagagagtgccggccccctcttgccctatcaggacctccactgccacatagaggccatgattgacccttagacaaagggctggtgtccaatcccagcccccagccccagaactccagggaatgaatgggcagagagcaggaatgtgggacatctgtgttcaagggaaggactccaggagtctgctgggaatgaggcctagtaggaaatgaggtggcccttgagggtacagaacaggttcattcttcgccaaattcccagcaccttgcaggcacttacagctgagtgagataatgcctgggttatgaaatcaaaaagttggaaagcaggtcagaggtcatctggtacagcccttccttcccttttttttttttttttttgtgagacaaggtctctctctgttgcccaggctggagtggcgcaaacacagctcactgcagcctcaacctactgggctcaagcaatcctccagcctcagcctcccaaagtgctgggattacaagcatgagccaccccactcagccctttccttcctttttaattgatgcataataattgtaagtattcatcatggtccaaccaaccctttcttgacccaccttcctagagagagggtcctcttgcttcagcggtcagggccccagacccatggtctggctccaggtaccacctgcctcatgcaggagttggcgtgcccaggaagctctgcctctgggcacagtgacctcagtggggtgaggggagctctccccatagctgggctgcggcccaaccccaccccctcaggctatgccagggggtgttgccaggggcacccgggcatcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagtgaggaggggatggggaaggggggccttgtgagcagaaggggctgaatccccaagaaggagtgcccgagaagtctcagggaggggccgaacctccctgctccctgggcctccctacctcttgatggggcactatccttgccccccaacatgatgggagggaccagaaacaggcccagggccccggggatctgatgcccgcatgccttctgccaggagtccagggtcccctcagcacctccctactggggaaagcagtgcaggagcagcggggcccctgtgtttcattcatggctgggctttgtgactgtgggcagcgagctcacctattctgagcctgtgtccatataaaggaggagttggaagcggagaaggttgatgtccatgagggagattggattctggggtgaagaaagtgagggaaagagcaggcaggtctgggcgcaaagcacaggtgactgcctgccaccagcttgtgacccccatcaagttactttgacttgcacagctgtgaagcggtggtcataataaaattcatttcaaaaggtggttacctgggatcagaggaatccccaggggcatggcgcttcactgagctgacaggacatgcatgtgtgccttcaagtgcaggaggacatgtgcgtgtgtgtgtgtgtgtgtgcaacagtgagtgtatgcttgtggatgcgcctgtgtgagcagaagcaggtgcaccaaccctgataaggcaccttagtaatgagttaaggcaaaagcccacatctgctcatcctccagacaagtcctctgtctaaggccccccaacccttaatcctcctgctgctctactggtcctgggtgggggtggtctctgtgacagctgcctcaagggagactgaggcaggtattcaagtgtcctcagaagagcctggacccaggaatgtgtccccccactccaggctccaggatgaaaccaacctgaggctggaagccgagaacaacctggctgcctatagacaggtcagggaggtggaggggaggggcaggggagggaggaaaggattgatggccacccacccaaacacagcccccaagctcagcccgccagagcaatgtgctgctccccactgccccagaaggaggggtaaggcaaggctgaggaatggggagaaggagcctggggccccagtggccctctactcctcacccctcctgccactccaggaagcagatgaagccaccctggcccgtctggatctggagaggaagattgagtcgctggaggaggagatccggttcttgaggaagatccacgaggaggtgaggccagggcagagggaggaaagctcaacacagagattgcaactgagagagggagagacagagacagagaagctgagactgagagagacactcagagagaggagagaaacagagattggcaggtagagacaggaaatgaaagacaaacagaaagacactaagggagacggaaagagacaagagagcattcgaactcctggccgaggggcaggcagaagaggacacaatggcgtggggaaccccagctgtggcctgtaccctgagccctggtaccgcttctctcaccctggtcaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaaggtagccctgcctgtgggccagcctgcctcctccaggcagcccttcttgctctgtacaagagaatgggggaaggagggtggaggaagctgggagaatatcctctccaggtgactgactttcaccagagaagtgagatggcttgcccagggtcacacaggcactattgctttcaaaagtacccattattattactgctactattgctattattagtagtagctgatactgttctgttctaagccctgtgcttttcatggattaccttactatgaagtaggtgctgttctttgacagatgagagagccgaagtccagagaggttaactaatttgctcaaagtcacacagctcctaagtggtagagttggatttccaactctagcacatctcacttgggagcctgcattccatgcctctgccagtctgttttgggttactgagcctctaccatatgccaggcaccccccaggacacagagaggtgtctgacctggaaggtgtgatattgacgtgcacccaaacatagtgcccgtagagaacaccacagctcagagcttatatgtagtgtgggagccaggaaagacactgtagagggggcatttgggctaggcaggacaggcacgctgtggacaggaagagaagaagggagggccattcctagtggaggacagagcctggaggcagaaaagcacagagaggcagggccccaagatgctagcctagccagggcacctagctgaggagtgtgagtggcagaagccactggtgtctgagcagggtgagggcccgatggggctgggaggacctccctgcaggcaggggagaaagggctattagaacccagggtgaggccaggcgaggtggctcacacctgtaatcccagcactttgggaggccgaggcatgcggatcacctgaggtcagcagttcaagactagcctggtcaacatggtgaaaccccgtctctactaaaaatacaaaatcagccgggtgtagtggcgcatgcctgtaatcccagctactcaggtggctggggcaggagaattgcttgaacctgggaggcagaggttgcagtgacccgggattgtgccactgacttccaacctgggcgacaagagcaagactctgtctcaaaataaaacaaaaaaaacaaaaaaacaaaaacacacaaaacacccaggcctccgctcgcctaagacgacagcgttcagtcccgcagatgcagctgtcagtgtggaaggttctggattctgtggcactgttcattcattcgcttgctgaccaggtgttgtgctaggtgctgaggtctggcagcccgctaccctgcccgcatccatgggtcacagttgttgggaaaagtcccagccagggccaacgtcctggggttaactggggtgctgctcacctccctgatttcccagagcccgtgcctgcccatgggcccacacagccccccatatgtgtcccccacctagtttgcagacctgacagacgctgctgcccgcaacgcggagctgctccgccaggccaagcacgaagccaacgactaccggcgccagttgcagtccttgacctgcgacctggagtctctgcgcggcacggtgagcgcggccagggcaggacggggacgggcggagcagggacggccaccccaggagatgccaggggagaagggccagggacgaggacctgggtcgagggcggggcctgaacgttacccccgggctagaggcggggcctggggccgggggccgggcctcgaaacctccccaagtcgggtcggggctccgcgggaccggccggctccatcccacagaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggtgagccctcatcacagcccctggggaagtctccctgctgcctcacggtagagctcatcttgctcccttcagggactgagtctttttcagccttgtgtgcagatcccttcccacctcaatgcccagcacagtgcctgcctcacacatagcaggcagtcactagatgtttgatgactgaatggatggatggattcaaccaatattgattaggcctcaaggccaaggacttgggtcaccctccaaactaagaggcatactccccatcttcccagccaagattggactcctcacctcacccatctcttctgcctccttggaactttcttcaccactttcccctcccttttccatcttccttcagatagacatgcgcccctcccagataacactcaagccccttgcagacgtttggaactccagatagcacgttggctgctggggaaaaagctaggagatggagttagactttcctggcaaggaaaagggcgttcaagttgtcatgatggccccgcaccaagacccagcctaggggtgtcccaggcagcccgggcagccctctccctctgctttctttcaggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcggggggaggggggagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgtatccgccacgccactccaaccacagtgggagctcatcttactccagcagcttaccactcgccaggcatgacgctaaatgctttcccagtgttatctcaccaccccctctgtccaccacgcaaggcagctgtggttactatcaagaaaagtaagacctgggaagtcggggacttcccaaggttacacagcctcgtggtggtggacctggggtctgtgtgaactcctaactgttgcactgtgcacgttccctgtcccctgcaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccagagtggactctgatctgttcatgagagggcgggactggggccaagatgtagcctttgacaagaccaactcatttcttattactgatcatctctggggcccatgccctcaccaaattccacccgcagccaaagaggacatacaccagctccctccactcttttcttccttcctctccctgctacctgcaactcaaccagcacaatcttcataggcaagaaagcaaagcagctcaaacatgattcaacactgatcagtgtttaccactggataaatctgagttcacactttccttctctgacctaaatgtgaagtcaggaaacacatgtgccctacttccatcctgagctcagtccccaatctcccaccagcctcaggcccctccacttctcagatcaggtcccagacctgcccatgaaaatggggagcaggctgtaacagatttgtccacatgttcctaccacctgtcccaacccagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtggggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgtttaccataaagattttgctttttcccttttatgagtggaggctgtaactggtatagccagcatttggttgggcacacactcatctctcaaggccagtgggctagaggcttggcagactctaagggtgggaaacaaaaccgctctcaacttcctgagctcttgactgtccatggatacacacagttcaaa

SEQ ID NO: 3 - DNA, 1839 bp, Homo sapiens
atcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattaaaaaaaaa

SEQ ID NO: 4-10 - skipped (7 entries)

SEQ ID NO: 11 - DNA, 19 bp, Artificial sequence
  Primer
ctggaggttgagagggaca

SEQ ID NO: 12 - DNA, 20 bp, Artificial sequence
  Primer
gcttcatctgcttcctgtct

SEQ ID NO: 13 - DNA, 23 bp, Artificial sequence
  Probe
ctggagcttctgcctcacagtgg

SEQ ID NO: 14 - DNA, 19 bp, Artificial sequence
  Primer
agttgcagtccttgacctg

SEQ ID NO: 15 - DNA, 19 bp, Artificial sequence
  Primer
cagcgcctcctgataactg

SEQ ID NO: 16 - DNA, 23 bp, Artificial sequence
  Probe
acgagtccctggagaggcagatg

SEQ ID NO: 17 - DNA, 15 bp, Artificial sequence
  Primer
tcgccgcttgctgca

SEQ ID NO: 18 - DNA, 23 bp, Artificial sequence
  Primer
ccatggtcaaccccaccgtgttc

SEQ ID NO: 19 - DNA, 27 bp, Artificial sequence
  Probe
aaggccgagaatgggaagcttgtcatc

SEQ ID NO: 20 - DNA, 20 bp, Artificial sequence
  Synthetic oligonucleotide
cagtattacctctactagtc

SEQ ID NO: 21 - DNA, 20 bp, Artificial sequence
  Synthetic oligonucleotide
cacattcactaatatttaac

SEQ ID NO: 22 - DNA, 20 bp, Artificial sequence
  Synthetic oligonucleotide
cgagggctttatgaaggagt

SEQ ID NO: 23 - DNA, 20 bp, Artificial sequence
  Synthetic oligonucleotide
gccaggagccaggcccccca

SEQ ID NO: 24 - DNA, 20 bp, Artificial sequence
  Synthetic oligonucleotide
ggcccgggtctccttgaagc

SEQ ID NO: 25 - DNA, 20 bp, Artificial sequence
  Synthetic oligonucleotide
gtcctgtgccagattgtccc

SEQ ID NO: 26 - DNA, 20 bp, Artificial sequence
  Synthetic oligonucleotide
catctgcttcctgtctatag

SEQ ID NO: 27 - DNA, 20 bp, Artificial sequence
  Synthetic oligonucleotide
ctcaagaaccggatctcctc

SEQ ID NO: 28 - DNA, 20 bp, Artificial sequence
  Synthetic oligonucleotide
actcttcggcttcatgcatg

SEQ ID NO: 29 - DNA, 20 bp, Artificial sequence
  Synthetic oligonucleotide
gcgcctcctgataactggcc

SEQ ID NO: 30 - DNA, 20 bp, Artificial sequence
  Synthetic oligonucleotide
cttctgacacagacttggtg

SEQ ID NO: 31 - DNA, 20 bp, Artificial sequence
  Synthetic oligonucleotide
atcccgcatctccacggtct

SEQ ID NO: 32 - DNA, 20 bp, Artificial sequence
  Synthetic oligonucleotide
ctgcctcacatcacatcctt

SEQ ID NO: 33 - DNA, 20 bp, Artificial sequence
  Synthetic oligonucleotide
cggagcaactatcctgcttc

SEQ ID NO: 34 - DNA, 20 bp, Artificial sequence
  Synthetic oligonucleotide
aagctgctggccatgcccct

SEQ ID NO: 35 - DNA, 20 bp, Artificial sequence
  Synthetic oligonucleotide
tgccccccgccctcctcccc

SEQ ID NO: 36 - DNA, 20 bp, Artificial sequence
  Synthetic oligonucleotide
gagagaacctccatctctgg

SEQ ID NO: 37 - DNA, 20 bp, Artificial sequence
  Synthetic oligonucleotide
tcagttttcctccagcagcc

SEQ ID NO: 38 - DNA, 20 bp, Artificial sequence
  Synthetic oligonucleotide
gacaaaacaagcctctggcc

SEQ ID NO: 39 - DNA, 20 bp, Artificial sequence
  Synthetic oligonucleotide
cgtccccacccatcttagac

SEQ ID NO: 40 - DNA, 20 bp, Artificial sequence
  Synthetic oligonucleotide
gtgctgagaatcaagctccc

SEQ ID NO: 41 - DNA, 20 bp, Artificial sequence
  Synthetic oligonucleotide
ccccctctatccctcccagc

SEQ ID NO: 42 - DNA, 20 bp, Artificial sequence
  Synthetic oligonucleotide
ctgggcttgacctctctgta

SEQ ID NO: 43 - DNA, 20 bp, Artificial sequence
  Synthetic oligonucleotide
tggtcacccacaacccctac

SEQ ID NO: 44 - DNA, 20 bp, Artificial sequence
  Synthetic oligonucleotide
ccctttctctcctgtttcag

SEQ ID NO: 45 - DNA, 20 bp, Artificial sequence
  Synthetic oligonucleotide
aagtcatgccctgcccccat

SEQ ID NO: 46 - DNA, 20 bp, Artificial sequence
  Synthetic oligonucleotide
gcacccggcctccaggctgc

SEQ ID NO: 47 - DNA, 20 bp, Artificial sequence
  Synthetic oligonucleotide
ggcacagatcccaccagtct

SEQ ID NO: 48 - DNA, 20 bp, Artificial sequence
  Synthetic oligonucleotide
gagaggagaaccctgaagtg

SEQ ID NO: 49 - DNA, 20 bp, Artificial sequence
  Synthetic oligonucleotide
cctcagcgactaaaggcagc

SEQ ID NO: 50 - DNA, 20 bp, Artificial sequence
  Synthetic oligonucleotide
gcgcagcatttgtctttatt

SEQ ID NO: 51 - DNA, 20 bp, Artificial sequence
  Synthetic oligonucleotide
gcttttgagatatcttgtga

SEQ ID NO: 52 - DNA, 20 bp, Artificial sequence
  Synthetic oligonucleotide
gtttaatgtacagttactct

SEQ ID NO: 53 - DNA, 20 bp, Artificial sequence
  Synthetic oligonucleotide
ccaaggactcaccaccttta

SEQ ID NO: 54 - DNA, 20 bp, Artificial sequence
  Synthetic oligonucleotide
agggatgaaagaataaagca

SEQ ID NO: 55 - DNA, 20 bp, Artificial sequence
  Synthetic oligonucleotide
cctgctgtactgacctcgaa

SEQ ID NO: 56 - DNA, 20 bp, Artificial sequence
  Synthetic oligonucleotide
atcctcagtcccagtctgga

SEQ ID NO: 57 - DNA, 20 bp, Artificial sequence
  Synthetic oligonucleotide
ctgcagtgtcacgaaggccc

SEQ ID NO: 58 - DNA, 20 bp, Artificial sequence
  Synthetic oligonucleotide
tgtcaagctctcacccagtt

SEQ ID NO: 59 - DNA, 20 bp, Artificial sequence
  Synthetic oligonucleotide
ttggtgcttttgccccctgt

SEQ ID NO: 60 - DNA, 20 bp, Artificial sequence
  Synthetic oligonucleotide
ggatagtgccccatcaagag

SEQ ID NO: 61 - DNA, 20 bp, Artificial sequence
  Synthetic oligonucleotide
agtcacaaagcccagccatg

SEQ ID NO: 62 - DNA, 20 bp, Artificial sequence
  Synthetic oligonucleotide
gcttccaactcctcctttat

SEQ ID NO: 63 - DNA, 20 bp, Artificial sequence
  Synthetic oligonucleotide
cagaatccaatctccctcat

SEQ ID NO: 64 - DNA, 20 bp, Artificial sequence
  Synthetic oligonucleotide
gctttgcgcccagacctgcc

SEQ ID NO: 65 - DNA, 20 bp, Artificial sequence
  Synthetic oligonucleotide
attcctctgatcccaggtaa

SEQ ID NO: 66 - DNA, 20 bp, Artificial sequence
  Synthetic oligonucleotide
ccttaactcattactaaggt

SEQ ID NO: 67 - DNA, 20 bp, Artificial sequence
  Synthetic oligonucleotide
gagaccacccccacccagga

SEQ ID NO: 68 - DNA, 20 bp, Artificial sequence
  Synthetic oligonucleotide
gtccaggctcttctgaggac

SEQ ID NO: 69 - DNA, 20 bp, Artificial sequence
  Synthetic oligonucleotide
gtggccatcaatcctttcct

SEQ ID NO: 70 - DNA, 20 bp, Artificial sequence
  Synthetic oligonucleotide
ccccaggctccttctcccca

SEQ ID NO: 71 - DNA, 20 bp, Artificial sequence
  Synthetic oligonucleotide
tgtctctacctgccaatctc

SEQ ID NO: 72 - DNA, 20 bp, Artificial sequence
  Synthetic oligonucleotide
ctcagggtacaggccacagc

SEQ ID NO: 73 - DNA, 20 bp, Artificial sequence
  Synthetic oligonucleotide
accctccttcccccattctc

SEQ ID NO: 74 - DNA, 20 bp, Artificial sequence
  Synthetic oligonucleotide
agctactactaataatagca

SEQ ID NO: 75 - DNA, 20 bp, Artificial sequence
  Synthetic oligonucleotide
acttcggctctctcatctgt

SEQ ID NO: 76 - DNA, 20 bp, Artificial sequence
  Synthetic oligonucleotide
aacccaaaacagactggcag

SEQ ID NO: 77 - DNA, 20 bp, Artificial sequence
  Synthetic oligonucleotide
cccacactacatataagctc

SEQ ID NO: 78 - DNA, 20 bp, Artificial sequence
  Synthetic oligonucleotide
cctgtcctgcctagcccaaa

SEQ ID NO: 79 - DNA, 20 bp, Artificial sequence
  Synthetic oligonucleotide
gggccctgcctctctgtgct

SEQ ID NO: 80 - DNA, 20 bp, Artificial sequence
  Synthetic oligonucleotide
atagccctttctcccctgcc

SEQ ID NO: 81 - DNA, 20 bp, Artificial sequence
  Synthetic oligonucleotide
aatccagaaccttccacact

SEQ ID NO: 82 - DNA, 20 bp, Artificial sequence
  Synthetic oligonucleotide
tgggacttttcccaacaact

SEQ ID NO: 83 - DNA, 20 bp, Artificial sequence
  Synthetic oligonucleotide
cgccctcgacccaggtcctc

SEQ ID NO: 84 - DNA, 20 bp, Artificial sequence
  Synthetic oligonucleotide
agtgactgcctgctatgtgt

SEQ ID NO: 85 - DNA, 20 bp, Artificial sequence
  Synthetic oligonucleotide
ttggagggtgacccaagtcc

SEQ ID NO: 86 - DNA, 20 bp, Artificial sequence
  Synthetic oligonucleotide
acgcccttttccttgccagg

SEQ ID NO: 87 - DNA, 20 bp, Artificial sequence
  Synthetic oligonucleotide
tagctcccccctccccccgc

SEQ ID NO: 88 - DNA, 20 bp, Artificial sequence
  Synthetic oligonucleotide
gcagtattacctctactagt

SEQ ID NO: 89 - DNA, 20 bp, Artificial sequence
  Synthetic oligonucleotide
cctgtcccctttcctctttc

SEQ ID NO: 90 - DNA, 20 bp, Artificial sequence
  Synthetic oligonucleotide
ccaccaaccagccacatgac

SEQ ID NO: 91 - DNA, 20 bp, Artificial sequence
  Synthetic oligonucleotide
atcaggagaccagagctcaa

SEQ ID NO: 92 - DNA, 20 bp, Artificial sequence
  Synthetic oligonucleotide
ggcctggcttcatttcagcc

SEQ ID NO: 93 - DNA, 20 bp, Artificial sequence
  Synthetic oligonucleotide
agtatgagaacctatgcaac

SEQ ID NO: 94 - DNA, 20 bp, Artificial sequence
  Synthetic oligonucleotide
gggcatgagccatcctctcc

SEQ ID NO: 95 - DNA, 20 bp, Artificial sequence
  Synthetic oligonucleotide
gactgggcccaaatccctcc

SEQ ID NO: 96 - DNA, 20 bp, Artificial sequence
  Synthetic oligonucleotide
ccttgctctcctccagaatt

SEQ ID NO: 97 - DNA, 20 bp, Artificial sequence
  Synthetic oligonucleotide
gctactaactttaattctct

SEQ ID NO: 98 - DNA, 20 bp, Artificial sequence
  Synthetic oligonucleotide
cctcttcccattcccctggt

SEQ ID NO: 99 - DNA, 20 bp, Artificial sequence
  Synthetic oligonucleotide
ggtcttacttttcttgatag

SEQ ID NO: 100 - DNA, 20 bp, Artificial sequence
  Synthetic oligonucleotide
gcgagggctttatgaaggag

SEQ ID NO: 101 - DNA, 20 bp, Artificial sequence
  Synthetic oligonucleotide
cggccaggagccaggccccc

SEQ ID NO: 102 - DNA, 20 bp, Artificial sequence
  Synthetic oligonucleotide
tcatctctgcccgctcactg

SEQ ID NO: 103 - DNA, 20 bp, Artificial sequence
  Synthetic oligonucleotide
aggtcctgtgccagattgtc

SEQ ID NO: 104 - DNA, 20 bp, Artificial sequence
  Synthetic oligonucleotide
tggcttcatctgcttcctgt

SEQ ID NO: 105 - DNA, 20 bp, Artificial sequence
  Synthetic oligonucleotide
tcctcaagaaccggatctcc

SEQ ID NO: 106 - DNA, 20 bp, Artificial sequence
  Synthetic oligonucleotide
gcggtaccactcttcggctt

SEQ ID NO: 107 - DNA, 20 bp, Artificial sequence
  Synthetic oligonucleotide
ccctcttcctccagccgcgc

SEQ ID NO: 108 - DNA, 20 bp, Artificial sequence
  Synthetic oligonucleotide
ccttctgacacagacttggt

SEQ ID NO: 109 - DNA, 20 bp, Artificial sequence
  Synthetic oligonucleotide
cctctccatcccgcatctcc

SEQ ID NO: 110 - DNA, 20 bp, Artificial sequence
  Synthetic oligonucleotide
cctgcctcacatcacatcct

SEQ ID NO: 111 - DNA, 20 bp, Artificial sequence
  Synthetic oligonucleotide
gcggagcaactatcctgctt

SEQ ID NO: 112 - DNA, 20 bp, Artificial sequence
  Synthetic oligonucleotide
cctcattctaacgcaagctg

SEQ ID NO: 113 - DNA, 20 bp, Artificial sequence
  Synthetic oligonucleotide
gtgccccccgccctcctccc

SEQ ID NO: 114 - DNA, 20 bp, Artificial sequence
  Synthetic oligonucleotide
tccgagagaacctccatctc

SEQ ID NO: 115 - DNA, 20 bp, Artificial sequence
  Synthetic oligonucleotide
ctcagttttcctccagcagc

SEQ ID NO: 116 - DNA, 20 bp, Artificial sequence
  Synthetic oligonucleotide
tcccacctcataaaaaccaa

SEQ ID NO: 117 - DNA, 20 bp, Artificial sequence
  Synthetic oligonucleotide
ggtgactgccccaggtggca

SEQ ID NO: 118 - DNA, 20 bp, Artificial sequence
  Synthetic oligonucleotide
agtgctgagaatcaagctcc

SEQ ID NO: 119 - DNA, 20 bp, Artificial sequence
  Synthetic oligonucleotide
cccccctctatccctcccag

SEQ ID NO: 120 - DNA, 20 bp, Artificial sequence
  Synthetic oligonucleotide
gtcccctccagtctgcacgg

SEQ ID NO: 121 - DNA, 20 bp, Artificial sequence
  Synthetic oligonucleotide
ctggtcacccacaaccccta

SEQ ID NO: 122 - DNA, 20 bp, Artificial sequence
  Synthetic oligonucleotide
cccctttctctcctgtttca

SEQ ID NO: 123 - DNA, 20 bp, Artificial sequence
  Synthetic oligonucleotide
ggacaaagtcatgccctgcc

SEQ ID NO: 124 - DNA, 20 bp, Artificial sequence
  Synthetic oligonucleotide
agcacccggcctccaggctg

SEQ ID NO: 125 - DNA, 20 bp, Artificial sequence
  Synthetic oligonucleotide
gggcacagatcccaccagtc

SEQ ID NO: 126 - DNA, 20 bp, Artificial sequence
  Synthetic oligonucleotide
cccttcttcggccttagagg

SEQ ID NO: 127 - DNA, 20 bp, Artificial sequence
  Synthetic oligonucleotide
tttttcctcagcgactaaag

SEQ ID NO: 128 - DNA, 20 bp, Artificial sequence
  Synthetic oligonucleotide
gggcgcagcatttgtcttta

SEQ ID NO: 129 - DNA, 20 bp, Artificial sequence
  Synthetic oligonucleotide
ggcttttgagatatcttgtg

SEQ ID NO: 130 - DNA, 20 bp, Artificial sequence
  Synthetic oligonucleotide
tgccagtttaatgtacagtt

SEQ ID NO: 131 - DNA, 20 bp, Artificial sequence
  Synthetic oligonucleotide
acccaaggactcaccacctt

SEQ ID NO: 132 - DNA, 20 bp, Artificial sequence
  Synthetic oligonucleotide
atggagcctcagggatgaaa

SEQ ID NO: 133 - DNA, 20 bp, Artificial sequence
  Synthetic oligonucleotide
ccctgctgtactgacctcga

SEQ ID NO: 134 - DNA, 20 bp, Artificial sequence
  Synthetic oligonucleotide
cctgatcctcagtcccagtc

SEQ ID NO: 135 - DNA, 20 bp, Artificial sequence
  Synthetic oligonucleotide
cgctgcagtgtcacgaaggc

SEQ ID NO: 136 - DNA, 20 bp, Artificial sequence
  Synthetic oligonucleotide
ggcagatgtcaagctctcac

SEQ ID NO: 137 - DNA, 20 bp, Artificial sequence
  Synthetic oligonucleotide
tcctcacttctgcctcacag

SEQ ID NO: 138 - DNA, 20 bp, Artificial sequence
  Synthetic oligonucleotide
aaggatagtgccccatcaag

SEQ ID NO: 139 - DNA, 20 bp, Artificial sequence
  Synthetic oligonucleotide
cagtcacaaagcccagccat

SEQ ID NO: 140 - DNA, 20 bp, Artificial sequence
  Synthetic oligonucleotide
ccgcttccaactcctccttt

SEQ ID NO: 141 - DNA, 20 bp, Artificial sequence
  Synthetic oligonucleotide
cccagaatccaatctccctc

SEQ ID NO: 142 - DNA, 20 bp, Artificial sequence
  Synthetic oligonucleotide
aggcagtcacctgtgctttg

SEQ ID NO: 143 - DNA, 20 bp, Artificial sequence
  Synthetic oligonucleotide
gattcctctgatcccaggta

SEQ ID NO: 144 - DNA, 20 bp, Artificial sequence
  Synthetic oligonucleotide
gccttaactcattactaagg

SEQ ID NO: 145 - DNA, 20 bp, Artificial sequence
  Synthetic oligonucleotide
agagaccacccccacccagg

SEQ ID NO: 146 - DNA, 20 bp, Artificial sequence
  Synthetic oligonucleotide
tggtttcatcctggagcctg

SEQ ID NO: 147 - DNA, 20 bp, Artificial sequence
  Synthetic oligonucleotide
ggtgggtggccatcaatcct

SEQ ID NO: 148 - DNA, 20 bp, Artificial sequence
  Synthetic oligonucleotide
catctgcttcctggagtggc

SEQ ID NO: 149 - DNA, 20 bp, Artificial sequence
  Synthetic oligonucleotide
tctttcatttcctgtctcta

SEQ ID NO: 150 - DNA, 20 bp, Artificial sequence
  Synthetic oligonucleotide
cccgaacctcctgaccaggg

SEQ ID NO: 151 - DNA, 20 bp, Artificial sequence
  Synthetic oligonucleotide
gcttcctccaccctccttcc

SEQ ID NO: 152 - DNA, 20 bp, Artificial sequence
  Synthetic oligonucleotide
cagctactactaataatagc

SEQ ID NO: 153 - DNA, 20 bp, Artificial sequence
  Synthetic oligonucleotide
ttagttaacctctctggact

SEQ ID NO: 154 - DNA, 20 bp, Artificial sequence
  Synthetic oligonucleotide
taacccaaaacagactggca

SEQ ID NO: 155 - DNA, 20 bp, Artificial sequence
  Synthetic oligonucleotide
tcccacactacatataagct

SEQ ID NO: 156 - DNA, 20 bp, Artificial sequence
  Synthetic oligonucleotide
gcctgtcctgcctagcccaa

SEQ ID NO: 157 - DNA, 20 bp, Artificial sequence
  Synthetic oligonucleotide
gccactcacactcctcagct

SEQ ID NO: 158 - DNA, 20 bp, Artificial sequence
  Synthetic oligonucleotide
tctaatagccctttctcccc

SEQ ID NO: 159 - DNA, 20 bp, Artificial sequence
  Synthetic oligonucleotide
agaatccagaaccttccaca

SEQ ID NO: 160 - DNA, 20 bp, Artificial sequence
  Synthetic oligonucleotide
ctgggacttttcccaacaac

SEQ ID NO: 161 - DNA, 20 bp, Artificial sequence
  Synthetic oligonucleotide
aggccccgccctcgacccag

SEQ ID NO: 162 - DNA, 20 bp, Artificial sequence
  Synthetic oligonucleotide
aaacatctagtgactgcctg

SEQ ID NO: 163 - DNA, 20 bp, Artificial sequence
  Synthetic oligonucleotide
aaggaggcagaagagatggg

SEQ ID NO: 164 - DNA, 20 bp, Artificial sequence
  Synthetic oligonucleotide
ctgggacacccctaggctgg

SEQ ID NO: 165 - DNA, 20 bp, Artificial sequence
  Synthetic oligonucleotide
ttagctcccccctccccccg

SEQ ID NO: 166 - DNA, 20 bp, Artificial sequence
  Synthetic oligonucleotide
tggcagtattacctctacta

SEQ ID NO: 167 - DNA, 20 bp, Artificial sequence
  Synthetic oligonucleotide
tcctgtcccctttcctcttt

SEQ ID NO: 168 - DNA, 20 bp, Artificial sequence
  Synthetic oligonucleotide
gccaccaaccagccacatga

SEQ ID NO: 169 - DNA, 20 bp, Artificial sequence
  Synthetic oligonucleotide
ctgtaatccccttactcggg

SEQ ID NO: 170 - DNA, 20 bp, Artificial sequence
  Synthetic oligonucleotide
ctgctctgtcttctggcctg

SEQ ID NO: 171 - DNA, 20 bp, Artificial sequence
  Synthetic oligonucleotide
gagtatgagaacctatgcaa

SEQ ID NO: 172 - DNA, 20 bp, Artificial sequence
  Synthetic oligonucleotide
agggcatgagccatcctctc

SEQ ID NO: 173 - DNA, 20 bp, Artificial sequence
  Synthetic oligonucleotide
ctgactgggcccaaatccct

SEQ ID NO: 174 - DNA, 20 bp, Artificial sequence
  Synthetic oligonucleotide
acattcagtttccttgctct

SEQ ID NO: 175 - DNA, 20 bp, Artificial sequence
  Synthetic oligonucleotide
agctactaactttaattctc

SEQ ID NO: 176 - DNA, 20 bp, Artificial sequence
  Synthetic oligonucleotide
gccaaatcccctcttcccat

SEQ ID NO: 177 - DNA, 20 bp, Artificial sequence
  Synthetic oligonucleotide
ccaggtcttacttttcttga

SEQ ID NO: 178 - DNA, 20 bp, Artificial sequence
  Synthetic oligonucleotide
ctcctctccatcctgctctg

SEQ ID NO: 179 - DNA, 20 bp, Artificial sequence
  Synthetic oligonucleotide
gacggcggccaggagccagg

SEQ ID NO: 180 - DNA, 20 bp, Artificial sequence
  Synthetic oligonucleotide
agctccatcatctctgcccg

SEQ ID NO: 181 - DNA, 20 bp, Artificial sequence
  Synthetic oligonucleotide
tggccaggtcctgtgccaga

SEQ ID NO: 182 - DNA, 20 bp, Artificial sequence
  Synthetic oligonucleotide
gggtggcttcatctgcttcc

SEQ ID NO: 183 - DNA, 20 bp, Artificial sequence
  Synthetic oligonucleotide
gatcttcctcaagaaccgga

SEQ ID NO: 184 - DNA, 20 bp, Artificial sequence
  Synthetic oligonucleotide
agcggtaccactcttcggct

SEQ ID NO: 185 - DNA, 20 bp, Artificial sequence
  Synthetic oligonucleotide
cccctcttcctccagccgcg

SEQ ID NO: 186 - DNA, 20 bp, Artificial sequence
  Synthetic oligonucleotide
gccttctgacacagacttgg

SEQ ID NO: 187 - DNA, 20 bp, Artificial sequence
  Synthetic oligonucleotide
atgacctctccatcccgcat

SEQ ID NO: 188 - DNA, 20 bp, Artificial sequence
  Synthetic oligonucleotide
tcctgcctcacatcacatcc

SEQ ID NO: 189 - DNA, 20 bp, Artificial sequence
  Synthetic oligonucleotide
gcaagctgacctagggacag

SEQ ID NO: 190 - DNA, 20 bp, Artificial sequence
  Synthetic oligonucleotide
tcctcattctaacgcaagct

SEQ ID NO: 191 - DNA, 20 bp, Artificial sequence
  Synthetic oligonucleotide
ggtgccccccgccctcctcc

SEQ ID NO: 192 - DNA, 20 bp, Artificial sequence
  Synthetic oligonucleotide
ctccgagagaacctccatct

SEQ ID NO: 193 - DNA, 20 bp, Artificial sequence
  Synthetic oligonucleotide
tctcagttttcctccagcag

SEQ ID NO: 194 - DNA, 20 bp, Artificial sequence
  Synthetic oligonucleotide
agcatagggatatcccacct

SEQ ID NO: 195 - DNA, 20 bp, Artificial sequence
  Synthetic oligonucleotide
ggcaggtgactgccccaggt

SEQ ID NO: 196 - DNA, 20 bp, Artificial sequence
  Synthetic oligonucleotide
aagtgctgagaatcaagctc

SEQ ID NO: 197 - DNA, 20 bp, Artificial sequence
  Synthetic oligonucleotide
gcccccctctatccctccca

SEQ ID NO: 198 - DNA, 20 bp, Artificial sequence
  Synthetic oligonucleotide
ctcctccatctctaccagcg

SEQ ID NO: 199 - DNA, 20 bp, Artificial sequence
  Synthetic oligonucleotide
actggtcacccacaacccct

SEQ ID NO: 200 - DNA, 20 bp, Artificial sequence
  Synthetic oligonucleotide
catcccctttctctcctgtt

SEQ ID NO: 201 - DNA, 20 bp, Artificial sequence
  Synthetic oligonucleotide
cggcctggtatgacacagca

SEQ ID NO: 202 - DNA, 20 bp, Artificial sequence
  Synthetic oligonucleotide
gagcacccggcctccaggct

SEQ ID NO: 203 - DNA, 20 bp, Artificial sequence
  Synthetic oligonucleotide
ctgggcacagatcccaccag

SEQ ID NO: 204 - DNA, 20 bp, Artificial sequence
  Synthetic oligonucleotide
ggacccttcttcggccttag

SEQ ID NO: 205 - DNA, 20 bp, Artificial sequence
  Synthetic oligonucleotide
ttatttttcctcagcgacta

SEQ ID NO: 206 - DNA, 20 bp, Artificial sequence
  Synthetic oligonucleotide
aagggcgcagcatttgtctt

SEQ ID NO: 207 - DNA, 20 bp, Artificial sequence
  Synthetic oligonucleotide
gtgaggcttttgagatatct

SEQ ID NO: 208 - DNA, 20 bp, Artificial sequence
  Synthetic oligonucleotide
tctgccagtttaatgtacag

SEQ ID NO: 209 - DNA, 20 bp, Artificial sequence
  Synthetic oligonucleotide
ctgcgcacccaaggactcac

SEQ ID NO: 210 - DNA, 20 bp, Artificial sequence
  Synthetic oligonucleotide
cctgagggaagaatcctctg

SEQ ID NO: 211 - DNA, 20 bp, Artificial sequence
  Synthetic oligonucleotide
ccacgaggccctgctgtact

SEQ ID NO: 212 - DNA, 20 bp, Artificial sequence
  Synthetic oligonucleotide
ccctgatcctcagtcccagt

SEQ ID NO: 213 - DNA, 20 bp, Artificial sequence
  Synthetic oligonucleotide
ccctggtatgataggctctg

SEQ ID NO: 214 - DNA, 20 bp, Artificial sequence
  Synthetic oligonucleotide
agggcagatgtcaagctctc

SEQ ID NO: 215 - DNA, 20 bp, Artificial sequence
  Synthetic oligonucleotide
tcccctcctcacttctgcct

SEQ ID NO: 216 - DNA, 20 bp, Artificial sequence
  Synthetic oligonucleotide
gcaaggatagtgccccatca

SEQ ID NO: 217 - DNA, 20 bp, Artificial sequence
  Synthetic oligonucleotide
ccacagtcacaaagcccagc

SEQ ID NO: 218 - DNA, 20 bp, Artificial sequence
  Synthetic oligonucleotide
tccgcttccaactcctcctt

SEQ ID NO: 219 - DNA, 20 bp, Artificial sequence
  Synthetic oligonucleotide
ccccagaatccaatctccct

SEQ ID NO: 220 - DNA, 20 bp, Artificial sequence
  Synthetic oligonucleotide
ccaccgcttcacagctgtgc

SEQ ID NO: 221 - DNA, 20 bp, Artificial sequence
  Synthetic oligonucleotide
gggattcctctgatcccagg

SEQ ID NO: 222 - DNA, 20 bp, Artificial sequence
  Synthetic oligonucleotide
tgccttaactcattactaag

SEQ ID NO: 223 - DNA, 20 bp, Artificial sequence
  Synthetic oligonucleotide
acagagaccacccccaccca

SEQ ID NO: 224 - DNA, 20 bp, Artificial sequence
  Synthetic oligonucleotide
ctgacctgtctataggcagc

SEQ ID NO: 225 - DNA, 20 bp, Artificial sequence
  Synthetic oligonucleotide
gccttacccctccttctggg

SEQ ID NO: 226 - DNA, 20 bp, Artificial sequence
  Synthetic oligonucleotide
tgccctggcctcacctcctc

SEQ ID NO: 227 - DNA, 20 bp, Artificial sequence
  Synthetic oligonucleotide
gtctttcatttcctgtctct

SEQ ID NO: 228 - DNA, 20 bp, Artificial sequence
  Synthetic oligonucleotide
tcccgaacctcctgaccagg

SEQ ID NO: 229 - DNA, 20 bp, Artificial sequence
  Synthetic oligonucleotide
ccagcttcctccaccctcct

SEQ ID NO: 230 - DNA, 20 bp, Artificial sequence
  Synthetic oligonucleotide
tcagctactactaataatag

SEQ ID NO: 231 - DNA, 20 bp, Artificial sequence
  Synthetic oligonucleotide
aactctaccacttaggagct

SEQ ID NO: 232 - DNA, 20 bp, Artificial sequence
  Synthetic oligonucleotide
gtaacccaaaacagactggc

SEQ ID NO: 233 - DNA, 20 bp, Artificial sequence
  Synthetic oligonucleotide
ctcccacactacatataagc

SEQ ID NO: 234 - DNA, 20 bp, Artificial sequence
  Synthetic oligonucleotide
tgcctgtcctgcctagccca

SEQ ID NO: 235 - DNA, 20 bp, Artificial sequence
  Synthetic oligonucleotide
tctgccactcacactcctca

SEQ ID NO: 236 - DNA, 20 bp, Artificial sequence
  Synthetic oligonucleotide
ttctaatagccctttctccc

SEQ ID NO: 237 - DNA, 20 bp, Artificial sequence
  Synthetic oligonucleotide
tcagcaagcgaatgaatgaa

SEQ ID NO: 238 - DNA, 20 bp, Artificial sequence
  Synthetic oligonucleotide
gctgggacttttcccaacaa

SEQ ID NO: 239 - DNA, 20 bp, Artificial sequence
  Synthetic oligonucleotide
aggccccgcctctagcccgg

SEQ ID NO: 240 - DNA, 20 bp, Artificial sequence
  Synthetic oligonucleotide
tcatcaaacatctagtgact

SEQ ID NO: 241 - DNA, 20 bp, Artificial sequence
  Synthetic oligonucleotide
tctatctgaaggaagatgga

SEQ ID NO: 242 - DNA, 20 bp, Artificial sequence
  Synthetic oligonucleotide
gtgatcctgaaagaaagcag

SEQ ID NO: 243 - DNA, 20 bp, Artificial sequence
  Synthetic oligonucleotide
tttagctcccccctcccccc

SEQ ID NO: 244 - DNA, 20 bp, Artificial sequence
  Synthetic oligonucleotide
tgctttagtgacctgtgact

SEQ ID NO: 245 - DNA, 20 bp, Artificial sequence
  Synthetic oligonucleotide
ctttcctgtcccctttcctc

SEQ ID NO: 246 - DNA, 20 bp, Artificial sequence
  Synthetic oligonucleotide
agccaccaaccagccacatg

SEQ ID NO: 247 - DNA, 20 bp, Artificial sequence
  Synthetic oligonucleotide
cctgtaatccccttactcgg

SEQ ID NO: 248 - DNA, 20 bp, Artificial sequence
  Synthetic oligonucleotide
gctgccagagtcctggctgc

SEQ ID NO: 249 - DNA, 20 bp, Artificial sequence
  Synthetic oligonucleotide
ccatcatgagtatgagaacc

SEQ ID NO: 250 - DNA, 20 bp, Artificial sequence
  Synthetic oligonucleotide
gaggcctctcatggactttc

SEQ ID NO: 251 - DNA, 20 bp, Artificial sequence
  Synthetic oligonucleotide
agccagagcctgactgggcc

SEQ ID NO: 252 - DNA, 20 bp, Artificial sequence
  Synthetic oligonucleotide
ggaattacattcagtttcct

SEQ ID NO: 253 - DNA, 20 bp, Artificial sequence
  Synthetic oligonucleotide
ctccccatccccaactgtgt

SEQ ID NO: 254 - DNA, 20 bp, Artificial sequence
  Synthetic oligonucleotide
cgccaaatcccctcttccca

SEQ ID NO: 255 - DNA, 20 bp, Artificial sequence
  Synthetic oligonucleotide
cccaggtcttacttttcttg

SEQ ID NO: 256 - DNA, 20 bp, Artificial sequence
  Synthetic oligonucleotide
cgtctcctctccatcctgct

SEQ ID NO: 257 - DNA, 20 bp, Artificial sequence
  Synthetic oligonucleotide
agacggcggccaggagccag

SEQ ID NO: 258 - DNA, 20 bp, Artificial sequence
  Synthetic oligonucleotide
gagctccatcatctctgccc

SEQ ID NO: 259 - DNA, 20 bp, Artificial sequence
  Synthetic oligonucleotide
cacagtggccaggtcctgtg

SEQ ID NO: 260 - DNA, 20 bp, Artificial sequence
  Synthetic oligonucleotide
agggtggcttcatctgcttc

SEQ ID NO: 261 - DNA, 20 bp, Artificial sequence
  Synthetic oligonucleotide
ggatcttcctcaagaaccgg

SEQ ID NO: 262 - DNA, 20 bp, Artificial sequence
  Synthetic oligonucleotide
gagcggtaccactcttcggc

SEQ ID NO: 263 - DNA, 20 bp, Artificial sequence
  Synthetic oligonucleotide
tgcccctcttcctccagccg

SEQ ID NO: 264 - DNA, 20 bp, Artificial sequence
  Synthetic oligonucleotide
ggccttctgacacagacttg

SEQ ID NO: 265 - DNA, 20 bp, Artificial sequence
  Synthetic oligonucleotide
taatgacctctccatcccgc

SEQ ID NO: 266 - DNA, 20 bp, Artificial sequence
  Synthetic oligonucleotide
gtcctgcctcacatcacatc

SEQ ID NO: 267 - DNA, 20 bp, Artificial sequence
  Synthetic oligonucleotide
cctgatactgacggagccta

SEQ ID NO: 268 - DNA, 20 bp, Artificial sequence
  Synthetic oligonucleotide
ctcctcattctaacgcaagc

SEQ ID NO: 269 - DNA, 20 bp, Artificial sequence
  Synthetic oligonucleotide
taggtgccccccgccctcct

SEQ ID NO: 270 - DNA, 20 bp, Artificial sequence
  Synthetic oligonucleotide
acagttcccagatactccga

SEQ ID NO: 271 - DNA, 20 bp, Artificial sequence
  Synthetic oligonucleotide
gtctcagttttcctccagca

SEQ ID NO: 272 - DNA, 20 bp, Artificial sequence
  Synthetic oligonucleotide
ccaatctataatcccagcta

SEQ ID NO: 273 - DNA, 20 bp, Artificial sequence
  Synthetic oligonucleotide
tgggcaggtgactgccccag

SEQ ID NO: 274 - DNA, 20 bp, Artificial sequence
  Synthetic oligonucleotide
cagatcccccaagtgctgag

SEQ ID NO: 275 - DNA, 20 bp, Artificial sequence
  Synthetic oligonucleotide
agcccccctctatccctccc

SEQ ID NO: 276 - DNA, 20 bp, Artificial sequence
  Synthetic oligonucleotide
tgcctcctcctccatctcta

SEQ ID NO: 277 - DNA, 20 bp, Artificial sequence
  Synthetic oligonucleotide
gcaactggtcacccacaacc

SEQ ID NO: 278 - DNA, 20 bp, Artificial sequence
  Synthetic oligonucleotide
acatcccctttctctcctgt

SEQ ID NO: 279 - DNA, 20 bp, Artificial sequence
  Synthetic oligonucleotide
tttgtgtgtgagtaagaagg

SEQ ID NO: 280 - DNA, 20 bp, Artificial sequence
  Synthetic oligonucleotide
cctgagcacccggcctccag

SEQ ID NO: 281 - DNA, 20 bp, Artificial sequence
  Synthetic oligonucleotide
tctgggcacagatcccacca

SEQ ID NO: 282 - DNA, 20 bp, Artificial sequence
  Synthetic oligonucleotide
aggacccttcttcggcctta

SEQ ID NO: 283 - DNA, 20 bp, Artificial sequence
  Synthetic oligonucleotide
tttatttttcctcagcgact

SEQ ID NO: 284 - DNA, 20 bp, Artificial sequence
  Synthetic oligonucleotide
ccccctcgaatctgcaggtt

SEQ ID NO: 285 - DNA, 20 bp, Artificial sequence
  Synthetic oligonucleotide
ttccatttacaatctggtga

SEQ ID NO: 286 - DNA, 20 bp, Artificial sequence
  Synthetic oligonucleotide
gctctgccagtttaatgtac

SEQ ID NO: 287 - DNA, 20 bp, Artificial sequence
  Synthetic oligonucleotide
actgcgcacccaaggactca

SEQ ID NO: 288 - DNA, 20 bp, Artificial sequence
  Synthetic oligonucleotide
actttattcactgcaagagc

SEQ ID NO: 289 - DNA, 20 bp, Artificial sequence
  Synthetic oligonucleotide
tgcccttcccacgaggccct

SEQ ID NO: 290 - DNA, 20 bp, Artificial sequence
  Synthetic oligonucleotide
gccctgatcctcagtcccag

SEQ ID NO: 291 - DNA, 20 bp, Artificial sequence
  Synthetic oligonucleotide
accctggtatgataggctct

SEQ ID NO: 292 - DNA, 20 bp, Artificial sequence
  Synthetic oligonucleotide
ctcagggatctgcagacagg

SEQ ID NO: 293 - DNA, 20 bp, Artificial sequence
  Synthetic oligonucleotide
atcccctcctcacttctgcc

SEQ ID NO: 294 - DNA, 20 bp, Artificial sequence
  Synthetic oligonucleotide
gtccctcccatcatgttggg

SEQ ID NO: 295 - DNA, 20 bp, Artificial sequence
  Synthetic oligonucleotide
gcccacagtcacaaagccca

SEQ ID NO: 296 - DNA, 20 bp, Artificial sequence
  Synthetic oligonucleotide
tctccgcttccaactcctcc

SEQ ID NO: 297 - DNA, 20 bp, Artificial sequence
  Synthetic oligonucleotide
accccagaatccaatctccc

SEQ ID NO: 298 - DNA, 20 bp, Artificial sequence
  Synthetic oligonucleotide
accttttgaaatgaatttta

SEQ ID NO: 299 - DNA, 20 bp, Artificial sequence
  Synthetic oligonucleotide
ctcctgcacttgaaggcaca

SEQ ID NO: 300 - DNA, 20 bp, Artificial sequence
  Synthetic oligonucleotide
ttgccttaactcattactaa

SEQ ID NO: 301 - DNA, 20 bp, Artificial sequence
  Synthetic oligonucleotide
tcacagagaccacccccacc

SEQ ID NO: 302 - DNA, 20 bp, Artificial sequence
  Synthetic oligonucleotide
cctccctgacctgtctatag

SEQ ID NO: 303 - DNA, 20 bp, Artificial sequence
  Synthetic oligonucleotide
tgccttacccctccttctgg

SEQ ID NO: 304 - DNA, 20 bp, Artificial sequence
  Synthetic oligonucleotide
tctgccctggcctcacctcc

SEQ ID NO: 305 - DNA, 20 bp, Artificial sequence
  Synthetic oligonucleotide
ttgtctttcatttcctgtct

SEQ ID NO: 306 - DNA, 20 bp, Artificial sequence
  Synthetic oligonucleotide
ttcccgaacctcctgaccag

SEQ ID NO: 307 - DNA, 20 bp, Artificial sequence
  Synthetic oligonucleotide
cccagcttcctccaccctcc

SEQ ID NO: 308 - DNA, 20 bp, Artificial sequence
  Synthetic oligonucleotide
atcagctactactaataata

SEQ ID NO: 309 - DNA, 20 bp, Artificial sequence
  Synthetic oligonucleotide
caactctaccacttaggagc

SEQ ID NO: 310 - DNA, 20 bp, Artificial sequence
  Synthetic oligonucleotide
cagtaacccaaaacagactg

SEQ ID NO: 311 - DNA, 20 bp, Artificial sequence
  Synthetic oligonucleotide
gctcccacactacatataag

SEQ ID NO: 312 - DNA, 20 bp, Artificial sequence
  Synthetic oligonucleotide
cttctcttcctgtccacagc

SEQ ID NO: 313 - DNA, 20 bp, Artificial sequence
  Synthetic oligonucleotide
ggcttctgccactcacactc

SEQ ID NO: 314 - DNA, 20 bp, Artificial sequence
  Synthetic oligonucleotide
gttctaatagccctttctcc

SEQ ID NO: 315 - DNA, 20 bp, Artificial sequence
  Synthetic oligonucleotide
gtcagcaagcgaatgaatga

SEQ ID NO: 316 - DNA, 20 bp, Artificial sequence
  Synthetic oligonucleotide
cagcaccccagttaacccca

SEQ ID NO: 317 - DNA, 20 bp, Artificial sequence
  Synthetic oligonucleotide
caggccccgcctctagcccg

SEQ ID NO: 318 - DNA, 20 bp, Artificial sequence
  Synthetic oligonucleotide
ccattcagtcatcaaacatc

SEQ ID NO: 319 - DNA, 20 bp, Artificial sequence
  Synthetic oligonucleotide
ggcgcatgtctatctgaagg

SEQ ID NO: 320 - DNA, 20 bp, Artificial sequence
  Synthetic oligonucleotide
ggtgatcctgaaagaaagca

SEQ ID NO: 321 - DNA, 20 bp, Artificial sequence
  Synthetic oligonucleotide
tgcaagtaaaaagtaattta

SEQ ID NO: 322 - DNA, 20 bp, Artificial sequence
  Synthetic oligonucleotide
tgtgctttagtgacctgtga

SEQ ID NO: 323 - DNA, 20 bp, Artificial sequence
  Synthetic oligonucleotide
ggtccctttcctgtcccctt

SEQ ID NO: 324 - DNA, 20 bp, Artificial sequence
  Synthetic oligonucleotide
tagccaccaaccagccacat

SEQ ID NO: 325 - DNA, 20 bp, Artificial sequence
  Synthetic oligonucleotide
acctgtaatccccttactcg

SEQ ID NO: 326 - DNA, 20 bp, Artificial sequence
  Synthetic oligonucleotide
gtgctgctgccagagtcctg

SEQ ID NO: 327 - DNA, 20 bp, Artificial sequence
  Synthetic oligonucleotide
ccccctccccatcatgagta

SEQ ID NO: 328 - DNA, 20 bp, Artificial sequence
  Synthetic oligonucleotide
ggctggtttctgcagatgtg

SEQ ID NO: 329 - DNA, 20 bp, Artificial sequence
  Synthetic oligonucleotide
cagccagagcctgactgggc

SEQ ID NO: 330 - DNA, 20 bp, Artificial sequence
  Synthetic oligonucleotide
ggaaacggaattacattcag

SEQ ID NO: 331 - DNA, 20 bp, Artificial sequence
  Synthetic oligonucleotide
cctccccatccccaactgtg

SEQ ID NO: 332 - DNA, 20 bp, Artificial sequence
  Synthetic oligonucleotide
acgccaaatcccctcttccc

SEQ ID NO: 333 - DNA, 20 bp, Artificial sequence
  Synthetic oligonucleotide
ccccgacttcccaggtctta

SEQ ID NO: 334 - DNA, 20 bp, Artificial sequence
  Synthetic oligonucleotide
accatcatctcccctgagga

SEQ ID NO: 335 - DNA, 20 bp, Artificial sequence
  Synthetic oligonucleotide
tgccaggacccagacggcgg

SEQ ID NO: 336 - DNA, 20 bp, Artificial sequence
  Synthetic oligonucleotide
ttgagctccatcatctctgc

SEQ ID NO: 337 - DNA, 20 bp, Artificial sequence
  Synthetic oligonucleotide
cctcacagtggccaggtcct

SEQ ID NO: 338 - DNA, 20 bp, Artificial sequence
  Synthetic oligonucleotide
tcttcctctccagatccaga

SEQ ID NO: 339 - DNA, 20 bp, Artificial sequence
  Synthetic oligonucleotide
tggatcttcctcaagaaccg

SEQ ID NO: 340 - DNA, 20 bp, Artificial sequence
  Synthetic oligonucleotide
ggagcggtaccactcttcgg

SEQ ID NO: 341 - DNA, 20 bp, Artificial sequence
  Synthetic oligonucleotide
gctctgcccctcttcctcca

SEQ ID NO: 342 - DNA, 20 bp, Artificial sequence
  Synthetic oligonucleotide
tggccttctgacacagactt

SEQ ID NO: 343 - DNA, 20 bp, Artificial sequence
  Synthetic oligonucleotide
ttaatgacctctccatcccg

SEQ ID NO: 344 - DNA, 20 bp, Artificial sequence
  Synthetic oligonucleotide
gggtcctgcctcacatcaca

SEQ ID NO: 345 - DNA, 20 bp, Artificial sequence
  Synthetic oligonucleotide
ggcctgatactgacggagcc

SEQ ID NO: 346 - DNA, 20 bp, Artificial sequence
  Synthetic oligonucleotide
cctcctcattctaacgcaag

SEQ ID NO: 347 - DNA, 20 bp, Artificial sequence
  Synthetic oligonucleotide
gtagtaggtgccccccgccc

SEQ ID NO: 348 - DNA, 20 bp, Artificial sequence
  Synthetic oligonucleotide
cacagttcccagatactccg

SEQ ID NO: 349 - DNA, 20 bp, Artificial sequence
  Synthetic oligonucleotide
agtctcagttttcctccagc

SEQ ID NO: 350 - DNA, 20 bp, Artificial sequence
  Synthetic oligonucleotide
ggagaacaaccctctgagct

SEQ ID NO: 351 - DNA, 20 bp, Artificial sequence
  Synthetic oligonucleotide
cacttgagtcatcgctcagg

SEQ ID NO: 352 - DNA, 20 bp, Artificial sequence
  Synthetic oligonucleotide
acagatcccccaagtgctga

SEQ ID NO: 353 - DNA, 20 bp, Artificial sequence
  Synthetic oligonucleotide
cagcccccctctatccctcc

SEQ ID NO: 354 - DNA, 20 bp, Artificial sequence
  Synthetic oligonucleotide
attgcctcctcctccatctc

SEQ ID NO: 355 - DNA, 20 bp, Artificial sequence
  Synthetic oligonucleotide
agaggccaagtgcaactggt

SEQ ID NO: 356 - DNA, 20 bp, Artificial sequence
  Synthetic oligonucleotide
tacatcccctttctctcctg

SEQ ID NO: 357 - DNA, 20 bp, Artificial sequence
  Synthetic oligonucleotide
cactacctagaatactgggt

SEQ ID NO: 358 - DNA, 20 bp, Artificial sequence
  Synthetic oligonucleotide
cgtgtcagccctgagcaccc

SEQ ID NO: 359 - DNA, 20 bp, Artificial sequence
  Synthetic oligonucleotide
ctctgggcacagatcccacc

SEQ ID NO: 360 - DNA, 20 bp, Artificial sequence
  Synthetic oligonucleotide
ggaaggacccttcttcggcc

SEQ ID NO: 361 - DNA, 20 bp, Artificial sequence
  Synthetic oligonucleotide
ctttatttttcctcagcgac

SEQ ID NO: 362 - DNA, 20 bp, Artificial sequence
  Synthetic oligonucleotide
gccccctcgaatctgcaggt

SEQ ID NO: 363 - DNA, 20 bp, Artificial sequence
  Synthetic oligonucleotide
gttccatttacaatctggtg

SEQ ID NO: 364 - DNA, 20 bp, Artificial sequence
  Synthetic oligonucleotide
ttaccactaacaagctctgc

SEQ ID NO: 365 - DNA, 20 bp, Artificial sequence
  Synthetic oligonucleotide
ccactgcgcacccaaggact

SEQ ID NO: 366 - DNA, 20 bp, Artificial sequence
  Synthetic oligonucleotide
acataaaactttattcactg

SEQ ID NO: 367 - DNA, 20 bp, Artificial sequence
  Synthetic oligonucleotide
gtgcccttcccacgaggccc

SEQ ID NO: 368 - DNA, 20 bp, Artificial sequence
  Synthetic oligonucleotide
tgccctgatcctcagtccca

SEQ ID NO: 369 - DNA, 20 bp, Artificial sequence
  Synthetic oligonucleotide
taccctggtatgataggctc

SEQ ID NO: 370 - DNA, 20 bp, Artificial sequence
  Synthetic oligonucleotide
gtgcttgctcagggatctgc

SEQ ID NO: 371 - DNA, 20 bp, Artificial sequence
  Synthetic oligonucleotide
ccatcccctcctcacttctg

SEQ ID NO: 372 - DNA, 20 bp, Artificial sequence
  Synthetic oligonucleotide
ggtccctcccatcatgttgg

SEQ ID NO: 373 - DNA, 20 bp, Artificial sequence
  Synthetic oligonucleotide
ctgcccacagtcacaaagcc

SEQ ID NO: 374 - DNA, 20 bp, Artificial sequence
  Synthetic oligonucleotide
ttctccgcttccaactcctc

SEQ ID NO: 375 - DNA, 20 bp, Artificial sequence
  Synthetic oligonucleotide
caccccagaatccaatctcc

SEQ ID NO: 376 - DNA, 20 bp, Artificial sequence
  Synthetic oligonucleotide
aaccaccttttgaaatgaat

SEQ ID NO: 377 - DNA, 20 bp, Artificial sequence
  Synthetic oligonucleotide
cacatgtcctcctgcacttg

SEQ ID NO: 378 - DNA, 20 bp, Artificial sequence
  Synthetic oligonucleotide
tttgccttaactcattacta

SEQ ID NO: 379 - DNA, 20 bp, Artificial sequence
  Synthetic oligonucleotide
gtcacagagaccacccccac

SEQ ID NO: 380 - DNA, 20 bp, Artificial sequence
  Synthetic oligonucleotide
acctccctgacctgtctata

SEQ ID NO: 381 - DNA, 20 bp, Artificial sequence
  Synthetic oligonucleotide
ttgccttacccctccttctg

SEQ ID NO: 382 - DNA, 20 bp, Artificial sequence
  Synthetic oligonucleotide
agctttcctccctctgccct

SEQ ID NO: 383 - DNA, 20 bp, Artificial sequence
  Synthetic oligonucleotide
gtttgtctttcatttcctgt

SEQ ID NO: 384 - DNA, 20 bp, Artificial sequence
  Synthetic oligonucleotide
gttcccgaacctcctgacca

SEQ ID NO: 385 - DNA, 20 bp, Artificial sequence
  Synthetic oligonucleotide
tcccagcttcctccaccctc

SEQ ID NO: 386 - DNA, 20 bp, Artificial sequence
  Synthetic oligonucleotide
tatcagctactactaataat

SEQ ID NO: 387 - DNA, 20 bp, Artificial sequence
  Synthetic oligonucleotide
ccaactctaccacttaggag

SEQ ID NO: 388 - DNA, 20 bp, Artificial sequence
  Synthetic oligonucleotide
tcagtaacccaaaacagact

SEQ ID NO: 389 - DNA, 20 bp, Artificial sequence
  Synthetic oligonucleotide
ggctcccacactacatataa

SEQ ID NO: 390 - DNA, 20 bp, Artificial sequence
  Synthetic oligonucleotide
tcttctcttcctgtccacag

SEQ ID NO: 391 - DNA, 20 bp, Artificial sequence
  Synthetic oligonucleotide
gtggcttctgccactcacac

SEQ ID NO: 392 - DNA, 20 bp, Artificial sequence
  Synthetic oligonucleotide
ccctgggttctaatagccct

SEQ ID NO: 393 - DNA, 20 bp, Artificial sequence
  Synthetic oligonucleotide
tggtcagcaagcgaatgaat

SEQ ID NO: 394 - DNA, 20 bp, Artificial sequence
  Synthetic oligonucleotide
agcagcaccccagttaaccc

SEQ ID NO: 395 - DNA, 20 bp, Artificial sequence
  Synthetic oligonucleotide
ccaggccccgcctctagccc

SEQ ID NO: 396 - DNA, 20 bp, Artificial sequence
  Synthetic oligonucleotide
ccatccattcagtcatcaaa

SEQ ID NO: 397 - DNA, 20 bp, Artificial sequence
  Synthetic oligonucleotide
ggcttgagtgttatctggga

SEQ ID NO: 398 - DNA, 20 bp, Artificial sequence
  Synthetic oligonucleotide
atggtgatcctgaaagaaag

SEQ ID NO: 399 - DNA, 20 bp, Artificial sequence
  Synthetic oligonucleotide
atgcaagtaaaaagtaattt

SEQ ID NO: 400 - DNA, 20 bp, Artificial sequence
  Synthetic oligonucleotide
tctgccatttatctgtgctt

SEQ ID NO: 401 - DNA, 20 bp, Artificial sequence
  Synthetic oligonucleotide
taggtccctttcctgtcccc

SEQ ID NO: 402 - DNA, 20 bp, Artificial sequence
  Synthetic oligonucleotide
ttagccaccaaccagccaca

SEQ ID NO: 403 - DNA, 20 bp, Artificial sequence
  Synthetic oligonucleotide
gcacctgtaatccccttact

SEQ ID NO: 404 - DNA, 20 bp, Artificial sequence
  Synthetic oligonucleotide
agtgctgctgccagagtcct

SEQ ID NO: 405 - DNA, 20 bp, Artificial sequence
  Synthetic oligonucleotide
cccccctccccatcatgagt

SEQ ID NO: 406 - DNA, 20 bp, Artificial sequence
  Synthetic oligonucleotide
tacctctccatcccgcatct

SEQ ID NO: 407 - DNA, 20 bp, Artificial sequence
  Synthetic oligonucleotide
tggccttgagaatccctggg

SEQ ID NO: 408 - DNA, 20 bp, Artificial sequence
  Synthetic oligonucleotide
ctgaggaaacggaattacat

SEQ ID NO: 409 - DNA, 20 bp, Artificial sequence
  Synthetic oligonucleotide
agccctccccatccccaact

SEQ ID NO: 410 - DNA, 20 bp, Artificial sequence
  Synthetic oligonucleotide
tacgccaaatcccctcttcc

SEQ ID NO: 411 - DNA, 20 bp, Artificial sequence
  Synthetic oligonucleotide
agtccccgacttcccaggtc

SEQ ID NO: 412 - DNA, 20 bp, Artificial sequence
  Synthetic oligonucleotide
caccatcatctcccctgagg

SEQ ID NO: 413 - DNA, 20 bp, Artificial sequence
  Synthetic oligonucleotide
gtgccaggacccagacggcg

SEQ ID NO: 414 - DNA, 20 bp, Artificial sequence
  Synthetic oligonucleotide
cattgagctccatcatctct

SEQ ID NO: 415 - DNA, 20 bp, Artificial sequence
  Synthetic oligonucleotide
tggtttcatcctggagcttc

SEQ ID NO: 416 - DNA, 20 bp, Artificial sequence
  Synthetic oligonucleotide
aatcttcctctccagatcca

SEQ ID NO: 417 - DNA, 20 bp, Artificial sequence
  Synthetic oligonucleotide
gtggatcttcctcaagaacc

SEQ ID NO: 418 - DNA, 20 bp, Artificial sequence
  Synthetic oligonucleotide
tggagcggtaccactcttcg

SEQ ID NO: 419 - DNA, 20 bp, Artificial sequence
  Synthetic oligonucleotide
aggctctgcccctcttcctc

SEQ ID NO: 420 - DNA, 20 bp, Artificial sequence
  Synthetic oligonucleotide
ggtggccttctgacacagac

SEQ ID NO: 421 - DNA, 20 bp, Artificial sequence
  Synthetic oligonucleotide
cttaatgacctctccatccc

SEQ ID NO: 422 - DNA, 20 bp, Artificial sequence
  Synthetic oligonucleotide
tgggtcctgcctcacatcac

SEQ ID NO: 423 - DNA, 20 bp, Artificial sequence
  Synthetic oligonucleotide
gcaggcctgatactgacgga

SEQ ID NO: 424 - DNA, 20 bp, Artificial sequence
  Synthetic oligonucleotide
tcctcctcattctaacgcaa

SEQ ID NO: 425 - DNA, 20 bp, Artificial sequence
  Synthetic oligonucleotide
gtggagggcgatgtagtagg

SEQ ID NO: 426 - DNA, 20 bp, Artificial sequence
  Synthetic oligonucleotide
gcacagttcccagatactcc

SEQ ID NO: 427 - DNA, 20 bp, Artificial sequence
  Synthetic oligonucleotide
cttccctttcctgtctgagt

SEQ ID NO: 428 - DNA, 20 bp, Artificial sequence
  Synthetic oligonucleotide
tctaggagaacaaccctctg

SEQ ID NO: 429 - DNA, 20 bp, Artificial sequence
  Synthetic oligonucleotide
gacacttgagtcatcgctca

SEQ ID NO: 430 - DNA, 20 bp, Artificial sequence
  Synthetic oligonucleotide
aacagatcccccaagtgctg

SEQ ID NO: 431 - DNA, 20 bp, Artificial sequence
  Synthetic oligonucleotide
gcagcccccctctatccctc

SEQ ID NO: 432 - DNA, 20 bp, Artificial sequence
  Synthetic oligonucleotide
cccaattgcctcctcctcca

SEQ ID NO: 433 - DNA, 20 bp, Artificial sequence
  Synthetic oligonucleotide
ttcccacaatccagaggcca

SEQ ID NO: 434 - DNA, 20 bp, Artificial sequence
  Synthetic oligonucleotide
atacatcccctttctctcct

SEQ ID NO: 435 - DNA, 20 bp, Artificial sequence
  Synthetic oligonucleotide
ggcactacctagaatactgg

SEQ ID NO: 436 - DNA, 20 bp, Artificial sequence
  Synthetic oligonucleotide
gtctgctcagtcaaagcaga

SEQ ID NO: 437 - DNA, 20 bp, Artificial sequence
  Synthetic oligonucleotide
cccagtcccatctctgggca

SEQ ID NO: 438 - DNA, 20 bp, Artificial sequence
  Synthetic oligonucleotide
gggaaggacccttcttcggc

SEQ ID NO: 439 - DNA, 20 bp, Artificial sequence
  Synthetic oligonucleotide
tctttatttttcctcagcga

SEQ ID NO: 440 - DNA, 20 bp, Artificial sequence
  Synthetic oligonucleotide
ttgccccctcgaatctgcag

SEQ ID NO: 441 - DNA, 20 bp, Artificial sequence
  Synthetic oligonucleotide
cgttccatttacaatctggt

SEQ ID NO: 442 - DNA, 20 bp, Artificial sequence
  Synthetic oligonucleotide
cctttaccactaacaagctc

SEQ ID NO: 443 - DNA, 20 bp, Artificial sequence
  Synthetic oligonucleotide
cagctccactgcgcacccaa

SEQ ID NO: 444 - DNA, 20 bp, Artificial sequence
  Synthetic oligonucleotide
agagcagggaacataaaact

SEQ ID NO: 445 - DNA, 20 bp, Artificial sequence
  Synthetic oligonucleotide
agtgcccttcccacgaggcc

SEQ ID NO: 446 - DNA, 20 bp, Artificial sequence
  Synthetic oligonucleotide
ttgccctgatcctcagtccc

SEQ ID NO: 447 - DNA, 20 bp, Artificial sequence
  Synthetic oligonucleotide
ccacctagaagtaccctggt

SEQ ID NO: 448 - DNA, 20 bp, Artificial sequence
  Synthetic oligonucleotide
gaaaacactcagaagggcag

SEQ ID NO: 449 - DNA, 20 bp, Artificial sequence
  Synthetic oligonucleotide
cccatcccctcctcacttct

SEQ ID NO: 450 - DNA, 20 bp, Artificial sequence
  Synthetic oligonucleotide
ctggtccctcccatcatgtt

SEQ ID NO: 451 - DNA, 20 bp, Artificial sequence
  Synthetic oligonucleotide
gctgcccacagtcacaaagc

SEQ ID NO: 452 - DNA, 20 bp, Artificial sequence
  Synthetic oligonucleotide
tcaaccttctccgcttccaa

SEQ ID NO: 453 - DNA, 20 bp, Artificial sequence
  Synthetic oligonucleotide
ttcttcaccccagaatccaa

SEQ ID NO: 454 - DNA, 20 bp, Artificial sequence
  Synthetic oligonucleotide
taaccaccttttgaaatgaa

SEQ ID NO: 455 - DNA, 20 bp, Artificial sequence
  Synthetic oligonucleotide
ctgctcacacaggcgcatcc

SEQ ID NO: 456 - DNA, 20 bp, Artificial sequence
  Synthetic oligonucleotide
ttttgccttaactcattact

SEQ ID NO: 457 - DNA, 20 bp, Artificial sequence
  Synthetic oligonucleotide
tgtcacagagaccaccccca

SEQ ID NO: 458 - DNA, 20 bp, Artificial sequence
  Synthetic oligonucleotide
tccacctccctgacctgtct

SEQ ID NO: 459 - DNA, 20 bp, Artificial sequence
  Synthetic oligonucleotide
gccttgccttacccctcctt

SEQ ID NO: 460 - DNA, 20 bp, Artificial sequence
  Synthetic oligonucleotide
tgagctttcctccctctgcc

SEQ ID NO: 461 - DNA, 20 bp, Artificial sequence
  Synthetic oligonucleotide
tagtgtctttctgtttgtct

SEQ ID NO: 462 - DNA, 20 bp, Artificial sequence
  Synthetic oligonucleotide
agttcccgaacctcctgacc

SEQ ID NO: 463 - DNA, 20 bp, Artificial sequence
  Synthetic oligonucleotide
ctcccagcttcctccaccct

SEQ ID NO: 464 - DNA, 20 bp, Artificial sequence
  Synthetic oligonucleotide
gtatcagctactactaataa

SEQ ID NO: 465 - DNA, 20 bp, Artificial sequence
  Synthetic oligonucleotide
tccaactctaccacttagga

SEQ ID NO: 466 - DNA, 20 bp, Artificial sequence
  Synthetic oligonucleotide
ctcagtaacccaaaacagac

SEQ ID NO: 467 - DNA, 20 bp, Artificial sequence
  Synthetic oligonucleotide
ctggctcccacactacatat

SEQ ID NO: 468 - DNA, 20 bp, Artificial sequence
  Synthetic oligonucleotide
ttcttctcttcctgtccaca

SEQ ID NO: 469 - DNA, 20 bp, Artificial sequence
  Synthetic oligonucleotide
agtggcttctgccactcaca

SEQ ID NO: 470 - DNA, 20 bp, Artificial sequence
  Synthetic oligonucleotide
accctgggttctaatagccc

SEQ ID NO: 471 - DNA, 20 bp, Artificial sequence
  Synthetic oligonucleotide
acctagcacaacacctggtc

SEQ ID NO: 472 - DNA, 20 bp, Artificial sequence
  Synthetic oligonucleotide
gcgctcaccgtgccgcgcag

SEQ ID NO: 473 - DNA, 20 bp, Artificial sequence
  Synthetic oligonucleotide
gagccccgacccgacttggg

SEQ ID NO: 474 - DNA, 20 bp, Artificial sequence
  Synthetic oligonucleotide
gttgaatccatccatccatt

SEQ ID NO: 475 - DNA, 20 bp, Artificial sequence
  Synthetic oligonucleotide
agctttttccccagcagcca

SEQ ID NO: 476 - DNA, 20 bp, Artificial sequence
  Synthetic oligonucleotide
aatggtgatcctgaaagaaa

SEQ ID NO: 477 - DNA, 20 bp, Artificial sequence
  Synthetic oligonucleotide
agctaagaatcatttcaggg

SEQ ID NO: 478 - DNA, 20 bp, Artificial sequence
  Synthetic oligonucleotide
ctctctgccatttatctgtg

SEQ ID NO: 479 - DNA, 20 bp, Artificial sequence
  Synthetic oligonucleotide
ataggtccctttcctgtccc

SEQ ID NO: 480 - DNA, 20 bp, Artificial sequence
  Synthetic oligonucleotide
cttagccaccaaccagccac

SEQ ID NO: 481 - DNA, 20 bp, Artificial sequence
  Synthetic oligonucleotide
cgcacctgtaatccccttac

SEQ ID NO: 482 - DNA, 20 bp, Artificial sequence
  Synthetic oligonucleotide
atcccaatagtgctgctgcc

SEQ ID NO: 483 - DNA, 20 bp, Artificial sequence
  Synthetic oligonucleotide
cgcacccccctccccatcat

SEQ ID NO: 484 - DNA, 20 bp, Artificial sequence
  Synthetic oligonucleotide
tccttacctctccatcccgc

SEQ ID NO: 485 - DNA, 20 bp, Artificial sequence
  Synthetic oligonucleotide
ggctttcctccatggcctgg

SEQ ID NO: 486 - DNA, 20 bp, Artificial sequence
  Synthetic oligonucleotide
gactgaggaaacggaattac

SEQ ID NO: 487 - DNA, 20 bp, Artificial sequence
  Synthetic oligonucleotide
atggaaagccctccccatcc

SEQ ID NO: 488 - DNA, 20 bp, Artificial sequence
  Synthetic oligonucleotide
atacgccaaatcccctcttc

SEQ ID NO: 489 - DNA, 20 bp, Artificial sequence
  Synthetic oligonucleotide
aagtccccgacttcccaggt

SEQ ID NO: 490 - DNA, 20 bp, Artificial sequence
  Synthetic oligonucleotide
cccaccatcatctcccctga

SEQ ID NO: 491 - DNA, 20 bp, Artificial sequence
  Synthetic oligonucleotide
ggcgggtgccaggacccaga

SEQ ID NO: 492 - DNA, 20 bp, Artificial sequence
  Synthetic oligonucleotide
agctggttcagctcagcagc

SEQ ID NO: 493 - DNA, 20 bp, Artificial sequence
  Synthetic oligonucleotide
ggttggtttcatcctggagc

SEQ ID NO: 494 - DNA, 20 bp, Artificial sequence
  Synthetic oligonucleotide
tcaatcttcctctccagatc

SEQ ID NO: 495 - DNA, 20 bp, Artificial sequence
  Synthetic oligonucleotide
gagttcccgaacctcctcct

SEQ ID NO: 496 - DNA, 20 bp, Artificial sequence
  Synthetic oligonucleotide
aggtctgcaaacttggagcg

SEQ ID NO: 497 - DNA, 20 bp, Artificial sequence
  Synthetic oligonucleotide
cttgaggctctgcccctctt

SEQ ID NO: 498 - DNA, 20 bp, Artificial sequence
  Synthetic oligonucleotide
aggtggccttctgacacaga

SEQ ID NO: 499 - DNA, 20 bp, Artificial sequence
  Synthetic oligonucleotide
ccttaatgacctctccatcc

SEQ ID NO: 500 - DNA, 20 bp, Artificial sequence
  Synthetic oligonucleotide
gtgggtcctgcctcacatca

SEQ ID NO: 501 - DNA, 20 bp, Artificial sequence
  Synthetic oligonucleotide
ggcaggcctgatactgacgg

SEQ ID NO: 502 - DNA, 20 bp, Artificial sequence
  Synthetic oligonucleotide
ttcctcctcattctaacgca

SEQ ID NO: 503 - DNA, 20 bp, Artificial sequence
  Synthetic oligonucleotide
tgtggagggcgatgtagtag

SEQ ID NO: 504 - DNA, 20 bp, Artificial sequence
  Synthetic oligonucleotide
ggcacagttcccagatactc

SEQ ID NO: 505 - DNA, 20 bp, Artificial sequence
  Synthetic oligonucleotide
ccttccctttcctgtctgag

SEQ ID NO: 506 - DNA, 20 bp, Artificial sequence
  Synthetic oligonucleotide
gtctaggagaacaaccctct

SEQ ID NO: 507 - DNA, 20 bp, Artificial sequence
  Synthetic oligonucleotide
gtggactgagacacttgagt

SEQ ID NO: 508 - DNA, 20 bp, Artificial sequence
  Synthetic oligonucleotide
cgtacacaacagatccccca

SEQ ID NO: 509 - DNA, 20 bp, Artificial sequence
  Synthetic oligonucleotide
ggcagcccccctctatccct

SEQ ID NO: 510 - DNA, 20 bp, Artificial sequence
  Synthetic oligonucleotide
tcccaattgcctcctcctcc

SEQ ID NO: 511 - DNA, 20 bp, Artificial sequence
  Synthetic oligonucleotide
ccttaattcccacaatccag

SEQ ID NO: 512 - DNA, 20 bp, Artificial sequence
  Synthetic oligonucleotide
gatacatcccctttctctcc

SEQ ID NO: 513 - DNA, 20 bp, Artificial sequence
  Synthetic oligonucleotide
gggcactacctagaatactg

SEQ ID NO: 514 - DNA, 20 bp, Artificial sequence
  Synthetic oligonucleotide
ctgctcaccagtctgctcag

SEQ ID NO: 515 - DNA, 20 bp, Artificial sequence
  Synthetic oligonucleotide
tcccagtcccatctctgggc

SEQ ID NO: 516 - DNA, 20 bp, Artificial sequence
  Synthetic oligonucleotide
agggaaggacccttcttcgg

SEQ ID NO: 517 - DNA, 20 bp, Artificial sequence
  Synthetic oligonucleotide
gtctttatttttcctcagcg

SEQ ID NO: 518 - DNA, 20 bp, Artificial sequence
  Synthetic oligonucleotide
tgcttttgccccctcgaatc

SEQ ID NO: 519 - DNA, 20 bp, Artificial sequence
  Synthetic oligonucleotide
gcagctaaccgcgagccggc

SEQ ID NO: 520 - DNA, 20 bp, Artificial sequence
  Synthetic oligonucleotide
acctttaccactaacaagct

SEQ ID NO: 521 - DNA, 20 bp, Artificial sequence
  Synthetic oligonucleotide
agcagctccactgcgcaccc

SEQ ID NO: 522 - DNA, 20 bp, Artificial sequence
  Synthetic oligonucleotide
atttaacattaagagcaggg

SEQ ID NO: 523 - DNA, 20 bp, Artificial sequence
  Synthetic oligonucleotide
cagtgcccttcccacgaggc

SEQ ID NO: 524 - DNA, 20 bp, Artificial sequence
  Synthetic oligonucleotide
cctttgccctgatcctcagt

SEQ ID NO: 525 - DNA, 20 bp, Artificial sequence
  Synthetic oligonucleotide
ccccacctagaagtaccctg

SEQ ID NO: 526 - DNA, 20 bp, Artificial sequence
  Synthetic oligonucleotide
agaaaacactcagaagggca

SEQ ID NO: 527 - DNA, 20 bp, Artificial sequence
  Synthetic oligonucleotide
ccccatcccctcctcacttc

SEQ ID NO: 528 - DNA, 20 bp, Artificial sequence
  Synthetic oligonucleotide
ttctggtccctcccatcatg

SEQ ID NO: 529 - DNA, 20 bp, Artificial sequence
  Synthetic oligonucleotide
gctcgctgcccacagtcaca

SEQ ID NO: 530 - DNA, 20 bp, Artificial sequence
  Synthetic oligonucleotide
gacatcaaccttctccgctt

SEQ ID NO: 531 - DNA, 20 bp, Artificial sequence
  Synthetic oligonucleotide
ctcactttcttcaccccaga

SEQ ID NO: 532 - DNA, 20 bp, Artificial sequence
  Synthetic oligonucleotide
ggtaaccaccttttgaaatg

SEQ ID NO: 533 - DNA, 20 bp, Artificial sequence
  Synthetic oligonucleotide
ttctgctcacacaggcgcat

SEQ ID NO: 534 - DNA, 20 bp, Artificial sequence
  Synthetic oligonucleotide
ggcttttgccttaactcatt

SEQ ID NO: 535 - DNA, 20 bp, Artificial sequence
  Synthetic oligonucleotide
gctgtcacagagaccacccc

SEQ ID NO: 536 - DNA, 20 bp, Artificial sequence
  Synthetic oligonucleotide
ccctccacctccctgacctg

SEQ ID NO: 537 - DNA, 20 bp, Artificial sequence
  Synthetic oligonucleotide
cagccttgccttacccctcc

SEQ ID NO: 538 - DNA, 20 bp, Artificial sequence
  Synthetic oligonucleotide
ttgagctttcctccctctgc

SEQ ID NO: 539 - DNA, 20 bp, Artificial sequence
  Synthetic oligonucleotide
ttccgtctcccttagtgtct

SEQ ID NO: 540 - DNA, 20 bp, Artificial sequence
  Synthetic oligonucleotide
gagttcccgaacctcctgac

SEQ ID NO: 541 - DNA, 20 bp, Artificial sequence
  Synthetic oligonucleotide
ggatattctcccagcttcct

SEQ ID NO: 542 - DNA, 20 bp, Artificial sequence
  Synthetic oligonucleotide
agaacagtatcagctactac

SEQ ID NO: 543 - DNA, 20 bp, Artificial sequence
  Synthetic oligonucleotide
ggaaatccaactctaccact

SEQ ID NO: 544 - DNA, 20 bp, Artificial sequence
  Synthetic oligonucleotide
gctcagtaacccaaaacaga

SEQ ID NO: 545 - DNA, 20 bp, Artificial sequence
  Synthetic oligonucleotide
cctggctcccacactacata

SEQ ID NO: 546 - DNA, 20 bp, Artificial sequence
  Synthetic oligonucleotide
ccttcttctcttcctgtcca

SEQ ID NO: 547 - DNA, 20 bp, Artificial sequence
  Synthetic oligonucleotide
tgctcagacaccagtggctt

SEQ ID NO: 548 - DNA, 20 bp, Artificial sequence
  Synthetic oligonucleotide
gcctggcctcaccctgggtt

SEQ ID NO: 549 - DNA, 20 bp, Artificial sequence
  Synthetic oligonucleotide
ctgccagacctcagcaccta

SEQ ID NO: 550 - DNA, 20 bp, Artificial sequence
  Synthetic oligonucleotide
ggccgcgctcaccgtgccgc

SEQ ID NO: 551 - DNA, 20 bp, Artificial sequence
  Synthetic oligonucleotide
ggagccccgacccgacttgg

SEQ ID NO: 552 - DNA, 20 bp, Artificial sequence
  Synthetic oligonucleotide
ggttgaatccatccatccat

SEQ ID NO: 553 - DNA, 20 bp, Artificial sequence
  Synthetic oligonucleotide
tagctttttccccagcagcc

SEQ ID NO: 554 - DNA, 20 bp, Artificial sequence
  Synthetic oligonucleotide
gaatggtgatcctgaaagaa

SEQ ID NO: 555 - DNA, 20 bp, Artificial sequence
  Synthetic oligonucleotide
agtggtcctaaatattctag

SEQ ID NO: 556 - DNA, 20 bp, Artificial sequence
  Synthetic oligonucleotide
tctctctgccatttatctgt

SEQ ID NO: 557 - DNA, 20 bp, Artificial sequence
  Synthetic oligonucleotide
cataggtccctttcctgtcc

SEQ ID NO: 558 - DNA, 20 bp, Artificial sequence
  Synthetic oligonucleotide
caacttagccaccaaccagc

SEQ ID NO: 559 - DNA, 20 bp, Artificial sequence
  Synthetic oligonucleotide
ggctttctgaaaacccagca

SEQ ID NO: 560 - DNA, 20 bp, Artificial sequence
  Synthetic oligonucleotide
cccccaaatcccaatagtgc

SEQ ID NO: 561 - DNA, 20 bp, Artificial sequence
  Synthetic oligonucleotide
tcgcacccccctccccatca

SEQ ID NO: 562 - DNA, 20 bp, Artificial sequence
  Synthetic oligonucleotide
ctccttacctctccatcccg

SEQ ID NO: 563 - DNA, 20 bp, Artificial sequence
  Synthetic oligonucleotide
aggctttcctccatggcctg

SEQ ID NO: 564 - DNA, 20 bp, Artificial sequence
  Synthetic oligonucleotide
tagaacagcctatggaggga

SEQ ID NO: 565 - DNA, 20 bp, Artificial sequence
  Synthetic oligonucleotide
gtttccttttaccaagctgg

SEQ ID NO: 566 - DNA, 20 bp, Artificial sequence
  Synthetic oligonucleotide
gatacgccaaatcccctctt

SEQ ID NO: 567 - DNA, 20 bp, Artificial sequence
  Synthetic oligonucleotide
gggaagtccccgacttccca

SEQ ID NO: 568 - DNA, 20 bp, Artificial sequence
  Synthetic oligonucleotide
ccccaccatcatctcccctg

SEQ ID NO: 569 - DNA, 20 bp, Artificial sequence
  Synthetic oligonucleotide
cattcgagccagggagaggc

SEQ ID NO: 570 - DNA, 20 bp, Artificial sequence
  Synthetic oligonucleotide
gctccttggcccgcagctgg

SEQ ID NO: 571 - DNA, 20 bp, Artificial sequence
  Synthetic oligonucleotide
aggttggtttcatcctggag

SEQ ID NO: 572 - DNA, 20 bp, Artificial sequence
  Synthetic oligonucleotide
ctcaatcttcctctccagat

SEQ ID NO: 573 - DNA, 20 bp, Artificial sequence
  Synthetic oligonucleotide
ctggagttcccgaacctcct

SEQ ID NO: 574 - DNA, 20 bp, Artificial sequence
  Synthetic oligonucleotide
agagactccaggtcgcaggt

SEQ ID NO: 575 - DNA, 20 bp, Artificial sequence
  Synthetic oligonucleotide
cctggtactcctgcaagtgg

SEQ ID NO: 576 - DNA, 20 bp, Artificial sequence
  Synthetic oligonucleotide
tgaggtggccttctgacaca

SEQ ID NO: 577 - DNA, 20 bp, Artificial sequence
  Synthetic oligonucleotide
ggactccttaatgacctctc

SEQ ID NO: 578 - DNA, 20 bp, Artificial sequence
  Synthetic oligonucleotide
agaggccaccaggtgggtcc

SEQ ID NO: 579 - DNA, 20 bp, Artificial sequence
  Synthetic oligonucleotide
tggcaggcctgatactgacg

SEQ ID NO: 580 - DNA, 20 bp, Artificial sequence
  Synthetic oligonucleotide
cttcctcctcattctaacgc

SEQ ID NO: 581 - DNA, 20 bp, Artificial sequence
  Synthetic oligonucleotide
acagtttccataacaacagg

SEQ ID NO: 582 - DNA, 20 bp, Artificial sequence
  Synthetic oligonucleotide
aaaggcacagttcccagata

SEQ ID NO: 583 - DNA, 20 bp, Artificial sequence
  Synthetic oligonucleotide
gccttccctttcctgtctga

SEQ ID NO: 584 - DNA, 20 bp, Artificial sequence
  Synthetic oligonucleotide
agtctaggagaacaaccctc

SEQ ID NO: 585 - DNA, 20 bp, Artificial sequence
  Synthetic oligonucleotide
gatggcatccctggatggca

SEQ ID NO: 586 - DNA, 20 bp, Artificial sequence
  Synthetic oligonucleotide
gcacctcatccctctccacg

SEQ ID NO: 587 - DNA, 20 bp, Artificial sequence
  Synthetic oligonucleotide
aggcagcccccctctatccc

SEQ ID NO: 588 - DNA, 20 bp, Artificial sequence
  Synthetic oligonucleotide
atcccaattgcctcctcctc

SEQ ID NO: 589 - DNA, 20 bp, Artificial sequence
  Synthetic oligonucleotide
tccttaattcccacaatcca

SEQ ID NO: 590 - DNA, 20 bp, Artificial sequence
  Synthetic oligonucleotide
ggatacatcccctttctctc

SEQ ID NO: 591 - DNA, 20 bp, Artificial sequence
  Synthetic oligonucleotide
gcctcagttttacaattgta

SEQ ID NO: 592 - DNA, 20 bp, Artificial sequence
  Synthetic oligonucleotide
tctgctcaccagtctgctca

SEQ ID NO: 593 - DNA, 20 bp, Artificial sequence
  Synthetic oligonucleotide
cctcccagtcccatctctgg

SEQ ID NO: 594 - DNA, 20 bp, Artificial sequence
  Synthetic oligonucleotide
ggagagggaaggacccttct

SEQ ID NO: 595 - DNA, 20 bp, Artificial sequence
  Synthetic oligonucleotide
tgtctttatttttcctcagc

SEQ ID NO: 596 - DNA, 20 bp, Artificial sequence
  Synthetic oligonucleotide
ggtgcttttgccccctcgaa

SEQ ID NO: 597 - DNA, 20 bp, Artificial sequence
  Synthetic oligonucleotide
ggcagctaaccgcgagccgg

SEQ ID NO: 598 - DNA, 20 bp, Artificial sequence
  Synthetic oligonucleotide
cacctttaccactaacaagc

SEQ ID NO: 599 - DNA, 20 bp, Artificial sequence
  Synthetic oligonucleotide
gagcagctccactgcgcacc

SEQ ID NO: 600 - DNA, 20 bp, Artificial sequence
  Synthetic oligonucleotide
tatttaacattaagagcagg

SEQ ID NO: 601 - DNA, 20 bp, Artificial sequence
  Synthetic oligonucleotide
ccagtgcccttcccacgagg

SEQ ID NO: 602 - DNA, 20 bp, Artificial sequence
  Synthetic oligonucleotide
tccctttgccctgatcctca

SEQ ID NO: 603 - DNA, 20 bp, Artificial sequence
  Synthetic oligonucleotide
agccccacctagaagtaccc

SEQ ID NO: 604 - DNA, 20 bp, Artificial sequence
  Synthetic oligonucleotide
cagaaaacactcagaagggc

SEQ ID NO: 605 - DNA, 20 bp, Artificial sequence
  Synthetic oligonucleotide
tccccatcccctcctcactt

SEQ ID NO: 606 - DNA, 20 bp, Artificial sequence
  Synthetic oligonucleotide
gtttctggtccctcccatca

SEQ ID NO: 607 - DNA, 20 bp, Artificial sequence
  Synthetic oligonucleotide
agctcgctgcccacagtcac

SEQ ID NO: 608 - DNA, 20 bp, Artificial sequence
  Synthetic oligonucleotide
ggacatcaaccttctccgct

SEQ ID NO: 609 - DNA, 20 bp, Artificial sequence
  Synthetic oligonucleotide
cctcactttcttcaccccag

SEQ ID NO: 610 - DNA, 20 bp, Artificial sequence
  Synthetic oligonucleotide
caggtaaccaccttttgaaa

SEQ ID NO: 611 - DNA, 20 bp, Artificial sequence
  Synthetic oligonucleotide
gcttctgctcacacaggcgc

SEQ ID NO: 612 - DNA, 20 bp, Artificial sequence
  Synthetic oligonucleotide
gggcttttgccttaactcat

SEQ ID NO: 613 - DNA, 20 bp, Artificial sequence
  Synthetic oligonucleotide
tcagtctcccttgaggcagc

SEQ ID NO: 614 - DNA, 20 bp, Artificial sequence
  Synthetic oligonucleotide
cccctccacctccctgacct

SEQ ID NO: 615 - DNA, 20 bp, Artificial sequence
  Synthetic oligonucleotide
tcagccttgccttacccctc

SEQ ID NO: 616 - DNA, 20 bp, Artificial sequence
  Synthetic oligonucleotide
gttgagctttcctccctctg

SEQ ID NO: 617 - DNA, 20 bp, Artificial sequence
  Synthetic oligonucleotide
tctctttccgtctcccttag

SEQ ID NO: 618 - DNA, 20 bp, Artificial sequence
  Synthetic oligonucleotide
ggcagggctaccttggagcg

SEQ ID NO: 619 - DNA, 20 bp, Artificial sequence
  Synthetic oligonucleotide
aggatattctcccagcttcc

SEQ ID NO: 620 - DNA, 20 bp, Artificial sequence
  Synthetic oligonucleotide
cagaacagtatcagctacta

SEQ ID NO: 621 - DNA, 20 bp, Artificial sequence
  Synthetic oligonucleotide
tggaaatccaactctaccac

SEQ ID NO: 622 - DNA, 20 bp, Artificial sequence
  Synthetic oligonucleotide
ggctcagtaacccaaaacag

SEQ ID NO: 623 - DNA, 20 bp, Artificial sequence
  Synthetic oligonucleotide
ttcctggctcccacactaca

SEQ ID NO: 624 - DNA, 20 bp, Artificial sequence
  Synthetic oligonucleotide
gccctcccttcttctcttcc

SEQ ID NO: 625 - DNA, 20 bp, Artificial sequence
  Synthetic oligonucleotide
ctgctcagacaccagtggct

SEQ ID NO: 626 - DNA, 20 bp, Artificial sequence
  Synthetic oligonucleotide
tcgcctggcctcaccctggg

SEQ ID NO: 627 - DNA, 20 bp, Artificial sequence
  Synthetic oligonucleotide
gctgccagacctcagcacct

SEQ ID NO: 628 - DNA, 20 bp, Artificial sequence
  Synthetic oligonucleotide
tgccctggccgcgctcaccg

SEQ ID NO: 629 - DNA, 20 bp, Artificial sequence
  Synthetic oligonucleotide
ccgcggagccccgacccgac

SEQ ID NO: 630 - DNA, 20 bp, Artificial sequence
  Synthetic oligonucleotide
tggttgaatccatccatcca

SEQ ID NO: 631 - DNA, 20 bp, Artificial sequence
  Synthetic oligonucleotide
ctagctttttccccagcagc

SEQ ID NO: 632 - DNA, 20 bp, Artificial sequence
  Synthetic oligonucleotide
ctaatatttaacattaagag

SEQ ID NO: 633 - DNA, 20 bp, Artificial sequence
  Synthetic oligonucleotide
tagtggtcctaaatattcta

SEQ ID NO: 634 - DNA, 20 bp, Artificial sequence
  Synthetic oligonucleotide
ttctctctgccatttatctg

SEQ ID NO: 635 - DNA, 20 bp, Artificial sequence
  Synthetic oligonucleotide
cacataggtccctttcctgt

SEQ ID NO: 636 - DNA, 20 bp, Artificial sequence
  Synthetic oligonucleotide
ccaacttagccaccaaccag

SEQ ID NO: 637 - DNA, 20 bp, Artificial sequence
  Synthetic oligonucleotide
tggctttctgaaaacccagc

SEQ ID NO: 638 - DNA, 20 bp, Artificial sequence
  Synthetic oligonucleotide
gcccccaaatcccaatagtg

SEQ ID NO: 639 - DNA, 20 bp, Artificial sequence
  Synthetic oligonucleotide
atcgcacccccctccccatc

SEQ ID NO: 640 - DNA, 20 bp, Artificial sequence
  Synthetic oligonucleotide
ccctccttacctctccatcc

SEQ ID NO: 641 - DNA, 20 bp, Artificial sequence
  Synthetic oligonucleotide
ccaggctttcctccatggcc

SEQ ID NO: 642 - DNA, 20 bp, Artificial sequence
  Synthetic oligonucleotide
ttagaacagcctatggaggg

SEQ ID NO: 643 - DNA, 20 bp, Artificial sequence
  Synthetic oligonucleotide
agtttccttttaccaagctg

SEQ ID NO: 644 - DNA, 20 bp, Artificial sequence
  Synthetic oligonucleotide
cggatacgccaaatcccctc

SEQ ID NO: 645 - DNA, 20 bp, Artificial sequence
  Synthetic oligonucleotide
caggtccaccaccacgaggc

SEQ ID NO: 646 - DNA, 20 bp, Artificial sequence
  Synthetic oligonucleotide
cccccaccatcatctcccct

SEQ ID NO: 647 - DNA, 20 bp, Artificial sequence
  Synthetic oligonucleotide
ggcattcgagccagggagag

SEQ ID NO: 648 - DNA, 20 bp, Artificial sequence
  Synthetic oligonucleotide
gttgatcgagccgcagccgc

SEQ ID NO: 649 - DNA, 20 bp, Artificial sequence
  Synthetic oligonucleotide
caggttggtttcatcctgga

SEQ ID NO: 650 - DNA, 20 bp, Artificial sequence
  Synthetic oligonucleotide
actcaatcttcctctccaga

SEQ ID NO: 651 - DNA, 20 bp, Artificial sequence
  Synthetic oligonucleotide
cctggagttcccgaacctcc

SEQ ID NO: 652 - DNA, 20 bp, Artificial sequence
  Synthetic oligonucleotide
cgcagagactccaggtcgca

SEQ ID NO: 653 - DNA, 20 bp, Artificial sequence
  Synthetic oligonucleotide
gtcctggtactcctgcaagt

SEQ ID NO: 654 - DNA, 20 bp, Artificial sequence
  Synthetic oligonucleotide
acgatgttcctcttgaggtg

SEQ ID NO: 655 - DNA, 20 bp, Artificial sequence
  Synthetic oligonucleotide
tggactccttaatgacctct

SEQ ID NO: 656 - DNA, 20 bp, Artificial sequence
  Synthetic oligonucleotide
gcagaggccaccaggtgggt

SEQ ID NO: 657 - DNA, 20 bp, Artificial sequence
  Synthetic oligonucleotide
ggtgagtttcttgttagttg

SEQ ID NO: 658 - DNA, 20 bp, Artificial sequence
  Synthetic oligonucleotide
ccttcctcctcattctaacg

SEQ ID NO: 659 - DNA, 20 bp, Artificial sequence
  Synthetic oligonucleotide
aacagtttccataacaacag

SEQ ID NO: 660 - DNA, 20 bp, Artificial sequence
  Synthetic oligonucleotide
caaaggcacagttcccagat

SEQ ID NO: 661 - DNA, 20 bp, Artificial sequence
  Synthetic oligonucleotide
ggccttccctttcctgtctg

SEQ ID NO: 662 - DNA, 20 bp, Artificial sequence
  Synthetic oligonucleotide
tagactgatcagggtcagtc

SEQ ID NO: 663 - DNA, 20 bp, Artificial sequence
  Synthetic oligonucleotide
cgtgcccacagatggcatcc

SEQ ID NO: 664 - DNA, 20 bp, Artificial sequence
  Synthetic oligonucleotide
ccagcacctcatccctctcc

SEQ ID NO: 665 - DNA, 20 bp, Artificial sequence
  Synthetic oligonucleotide
ccaggcagcccccctctatc

SEQ ID NO: 666 - DNA, 20 bp, Artificial sequence
  Synthetic oligonucleotide
ccatcccaattgcctcctcc

SEQ ID NO: 667 - DNA, 20 bp, Artificial sequence
  Synthetic oligonucleotide
acttccttaattcccacaat

SEQ ID NO: 668 - DNA, 20 bp, Artificial sequence
  Synthetic oligonucleotide
atggatacatcccctttctc

SEQ ID NO: 669 - DNA, 20 bp, Artificial sequence
  Synthetic oligonucleotide
tgcctcagttttacaattgt

SEQ ID NO: 670 - DNA, 20 bp, Artificial sequence
  Synthetic oligonucleotide
gtctgctcaccagtctgctc

SEQ ID NO: 671 - DNA, 20 bp, Artificial sequence
  Synthetic oligonucleotide
ggccctcccagtcccatctc

SEQ ID NO: 672 - DNA, 20 bp, Artificial sequence
  Synthetic oligonucleotide
aaaggacaccaagtcttggg

SEQ ID NO: 673 - DNA, 20 bp, Artificial sequence
  Synthetic oligonucleotide
ttgtctttatttttcctcag

SEQ ID NO: 674 - DNA, 20 bp, Artificial sequence
  Synthetic oligonucleotide
ttggtgcttttgccccctcg

SEQ ID NO: 675 - DNA, 20 bp, Artificial sequence
  Synthetic oligonucleotide
aggcagctaaccgcgagccg

SEQ ID NO: 676 - DNA, 20 bp, Artificial sequence
  Synthetic oligonucleotide
ccacctttaccactaacaag

SEQ ID NO: 677 - DNA, 20 bp, Artificial sequence
  Synthetic oligonucleotide
tcagaggccccagagcagct

SEQ ID NO: 678 - DNA, 20 bp, Artificial sequence
  Synthetic oligonucleotide
aatatttaacattaagagca

SEQ ID NO: 679 - DNA, 20 bp, Artificial sequence
  Synthetic oligonucleotide
ctccagtgcccttcccacga

SEQ ID NO: 680 - DNA, 20 bp, Artificial sequence
  Synthetic oligonucleotide
gatccctttgccctgatcct

SEQ ID NO: 681 - DNA, 20 bp, Artificial sequence
  Synthetic oligonucleotide
gcaagccccacctagaagta

SEQ ID NO: 682 - DNA, 20 bp, Artificial sequence
  Synthetic oligonucleotide
acagaaaacactcagaaggg

SEQ ID NO: 683 - DNA, 20 bp, Artificial sequence
  Synthetic oligonucleotide
aggccccccttccccatccc

SEQ ID NO: 684 - DNA, 20 bp, Artificial sequence
  Synthetic oligonucleotide
ggccctgggcctgtttctgg

SEQ ID NO: 685 - DNA, 20 bp, Artificial sequence
  Synthetic oligonucleotide
gagctcgctgcccacagtca

SEQ ID NO: 686 - DNA, 20 bp, Artificial sequence
  Synthetic oligonucleotide
tggacatcaaccttctccgc

SEQ ID NO: 687 - DNA, 20 bp, Artificial sequence
  Synthetic oligonucleotide
ccctcactttcttcacccca

SEQ ID NO: 688 - DNA, 20 bp, Artificial sequence
  Synthetic oligonucleotide
ccaggtaaccaccttttgaa

SEQ ID NO: 689 - DNA, 20 bp, Artificial sequence
  Synthetic oligonucleotide
gtgccttatcagggttggtg

SEQ ID NO: 690 - DNA, 20 bp, Artificial sequence
  Synthetic oligonucleotide
tgggcttttgccttaactca

SEQ ID NO: 691 - DNA, 20 bp, Artificial sequence
  Synthetic oligonucleotide
cctcagtctcccttgaggca

SEQ ID NO: 692 - DNA, 20 bp, Artificial sequence
  Synthetic oligonucleotide
ccctcccctccacctccctg

SEQ ID NO: 693 - DNA, 20 bp, Artificial sequence
  Synthetic oligonucleotide
ctcagccttgccttacccct

SEQ ID NO: 694 - DNA, 20 bp, Artificial sequence
  Synthetic oligonucleotide
tctccctctctcagttgcaa

SEQ ID NO: 695 - DNA, 20 bp, Artificial sequence
  Synthetic oligonucleotide
tgtctctttccgtctccctt

SEQ ID NO: 696 - DNA, 20 bp, Artificial sequence
  Synthetic oligonucleotide
caggctggcccacaggcagg

SEQ ID NO: 697 - DNA, 20 bp, Artificial sequence
  Synthetic oligonucleotide
gaggatattctcccagcttc

SEQ ID NO: 698 - DNA, 20 bp, Artificial sequence
  Synthetic oligonucleotide
cacctacttcatagtaaggt

SEQ ID NO: 699 - DNA, 20 bp, Artificial sequence
  Synthetic oligonucleotide
gttggaaatccaactctacc

SEQ ID NO: 700 - DNA, 20 bp, Artificial sequence
  Synthetic oligonucleotide
aggctcagtaacccaaaaca

SEQ ID NO: 701 - DNA, 20 bp, Artificial sequence
  Synthetic oligonucleotide
cagtgtctttcctggctccc

SEQ ID NO: 702 - DNA, 20 bp, Artificial sequence
  Synthetic oligonucleotide
ggccctcccttcttctcttc

SEQ ID NO: 703 - DNA, 20 bp, Artificial sequence
  Synthetic oligonucleotide
caccctgctcagacaccagt

SEQ ID NO: 704 - DNA, 20 bp, Artificial sequence
  Synthetic oligonucleotide
ctcgcctggcctcaccctgg

SEQ ID NO: 705 - DNA, 20 bp, Artificial sequence
  Synthetic oligonucleotide
gcgggctgccagacctcagc

SEQ ID NO: 706 - DNA, 20 bp, Artificial sequence
  Synthetic oligonucleotide
cccgtcctgccctggccgcg

SEQ ID NO: 707 - DNA, 20 bp, Artificial sequence
  Synthetic oligonucleotide
aaaaagactcagtccctgaa

SEQ ID NO: 708 - DNA, 20 bp, Artificial sequence
  Synthetic oligonucleotide
ttggttgaatccatccatcc

SEQ ID NO: 709 - DNA, 20 bp, Artificial sequence
  Synthetic oligonucleotide
cctagctttttccccagcag

SEQ ID NO: 710 - DNA, 20 bp, Artificial sequence
  Synthetic oligonucleotide
actaatatttaacattaaga

SEQ ID NO: 711 - DNA, 20 bp, Artificial sequence
  Synthetic oligonucleotide
tctagtggtcctaaatattc

SEQ ID NO: 712 - DNA, 20 bp, Artificial sequence
  Synthetic oligonucleotide
ttcctacttctctctgccat

SEQ ID NO: 713 - DNA, 20 bp, Artificial sequence
  Synthetic oligonucleotide
gctcaatacacataggtccc

SEQ ID NO: 714 - DNA, 20 bp, Artificial sequence
  Synthetic oligonucleotide
cccaacttagccaccaacca

SEQ ID NO: 715 - DNA, 20 bp, Artificial sequence
  Synthetic oligonucleotide
ctggctttctgaaaacccag

SEQ ID NO: 716 - DNA, 20 bp, Artificial sequence
  Synthetic oligonucleotide
agcccccaaatcccaatagt

SEQ ID NO: 717 - DNA, 20 bp, Artificial sequence
  Synthetic oligonucleotide
ccatcgcacccccctcccca

SEQ ID NO: 718 - DNA, 20 bp, Artificial sequence
  Synthetic oligonucleotide
tccctccttacctctccatc

SEQ ID NO: 719 - DNA, 20 bp, Artificial sequence
  Synthetic oligonucleotide
cccaggctttcctccatggc

SEQ ID NO: 720 - DNA, 20 bp, Artificial sequence
  Synthetic oligonucleotide
cttagaacagcctatggagg

SEQ ID NO: 721 - DNA, 20 bp, Artificial sequence
  Synthetic oligonucleotide
tagtttccttttaccaagct

SEQ ID NO: 722 - DNA, 20 bp, Artificial sequence
  Synthetic oligonucleotide
gcggatacgccaaatcccct

SEQ ID NO: 723 - DNA, 20 bp, Artificial sequence
  Synthetic oligonucleotide
cccaggtccaccaccacgag

SEQ ID NO: 724 - DNA, 20 bp, Artificial sequence
  Synthetic oligonucleotide
gccccccaccatcatctccc

SEQ ID NO: 725 - DNA, 20 bp, Artificial sequence
  Synthetic oligonucleotide
ccagggagaaatccacccgg

SEQ ID NO: 726 - DNA, 20 bp, Artificial sequence
  Synthetic oligonucleotide
ggtgagttgatcgagccgca

SEQ ID NO: 727 - DNA, 20 bp, Artificial sequence
  Synthetic oligonucleotide
ttccagcctcaggttggttt

SEQ ID NO: 728 - DNA, 20 bp, Artificial sequence
  Synthetic oligonucleotide
ccagcgactcaatcttcctc

SEQ ID NO: 729 - DNA, 20 bp, Artificial sequence
  Synthetic oligonucleotide
tgctgtcgggccagctgctc

SEQ ID NO: 730 - DNA, 20 bp, Artificial sequence
  Synthetic oligonucleotide
cctcctgctcgcgcatctgc

SEQ ID NO: 731 - DNA, 20 bp, Artificial sequence
  Synthetic oligonucleotide
ggtcctggtactcctgcaag

SEQ ID NO: 732 - DNA, 20 bp, Artificial sequence
  Synthetic oligonucleotide
cacgatgttcctcttgaggt

SEQ ID NO: 733 - DNA, 20 bp, Artificial sequence
  Synthetic oligonucleotide
ttggactccttaatgacctc

SEQ ID NO: 734 - DNA, 20 bp, Artificial sequence
  Synthetic oligonucleotide
tcgggcccctcatgagacgg

SEQ ID NO: 735 - DNA, 20 bp, Artificial sequence
  Synthetic oligonucleotide
atgcccctccagactgcccc

SEQ ID NO: 736 - DNA, 20 bp, Artificial sequence
  Synthetic oligonucleotide
ctccttcctcctcattctaa

SEQ ID NO: 737 - DNA, 20 bp, Artificial sequence
  Synthetic oligonucleotide
caacagtttccataacaaca

SEQ ID NO: 738 - DNA, 20 bp, Artificial sequence
  Synthetic oligonucleotide
gaggaaactcaaaggcacag

SEQ ID NO: 739 - DNA, 20 bp, Artificial sequence
  Synthetic oligonucleotide
gggccttccctttcctgtct

SEQ ID NO: 740 - DNA, 20 bp, Artificial sequence
  Synthetic oligonucleotide
tcttagactgatcagggtca

SEQ ID NO: 741 - DNA, 20 bp, Artificial sequence
  Synthetic oligonucleotide
gctcccacctgcccacagcg

SEQ ID NO: 742 - DNA, 20 bp, Artificial sequence
  Synthetic oligonucleotide
tcccagcacctcatccctct

SEQ ID NO: 743 - DNA, 20 bp, Artificial sequence
  Synthetic oligonucleotide
gccaggcagcccccctctat

SEQ ID NO: 744 - DNA, 20 bp, Artificial sequence
  Synthetic oligonucleotide
caacccctacttgtatgcct

SEQ ID NO: 745 - DNA, 20 bp, Artificial sequence
  Synthetic oligonucleotide
agaggatgagtcacttcctt

SEQ ID NO: 746 - DNA, 20 bp, Artificial sequence
  Synthetic oligonucleotide
catggatacatcccctttct

SEQ ID NO: 747 - DNA, 20 bp, Artificial sequence
  Synthetic oligonucleotide
cagtgtcttcactttgctcg

SEQ ID NO: 748 - DNA, 20 bp, Artificial sequence
  Synthetic oligonucleotide
agtctgctcaccagtctgct

SEQ ID NO: 749 - DNA, 20 bp, Artificial sequence
  Synthetic oligonucleotide
gggccctcccagtcccatct

SEQ ID NO: 750 - DNA, 20 bp, Artificial sequence
  Synthetic oligonucleotide
gaaaggacaccaagtcttgg

SEQ ID NO: 751 - DNA, 20 bp, Artificial sequence
  Synthetic oligonucleotide
tttgtctttatttttcctca

SEQ ID NO: 752 - DNA, 20 bp, Artificial sequence
  Synthetic oligonucleotide
gattttccccgtctttggtg

SEQ ID NO: 753 - DNA, 20 bp, Artificial sequence
  Synthetic oligonucleotide
gtgaggctcactccctgtca

SEQ ID NO: 754 - DNA, 20 bp, Artificial sequence
  Synthetic oligonucleotide
accacctttaccactaacaa

SEQ ID NO: 755 - DNA, 20 bp, Artificial sequence
  Synthetic oligonucleotide
gcttgctcagaggccccaga

SEQ ID NO: 756 - DNA, 20 bp, Artificial sequence
  Synthetic oligonucleotide
taatatttaacattaagagc

SEQ ID NO: 757 - DNA, 20 bp, Artificial sequence
  Synthetic oligonucleotide
gactccagtgcccttcccac

SEQ ID NO: 758 - DNA, 20 bp, Artificial sequence
  Synthetic oligonucleotide
tggatccctttgccctgatc

SEQ ID NO: 759 - DNA, 20 bp, Artificial sequence
  Synthetic oligonucleotide
gctgcaagccccacctagaa

SEQ ID NO: 760 - DNA, 20 bp, Artificial sequence
  Synthetic oligonucleotide
aacagaaaacactcagaagg

SEQ ID NO: 761 - DNA, 20 bp, Artificial sequence
  Synthetic oligonucleotide
aaggccccccttccccatcc

SEQ ID NO: 762 - DNA, 20 bp, Artificial sequence
  Synthetic oligonucleotide
tgcgggcatcagatccccgg

SEQ ID NO: 763 - DNA, 20 bp, Artificial sequence
  Synthetic oligonucleotide
tcctcctttatatggacaca

SEQ ID NO: 764 - DNA, 20 bp, Artificial sequence
  Synthetic oligonucleotide
atggacatcaaccttctccg

SEQ ID NO: 765 - DNA, 20 bp, Artificial sequence
  Synthetic oligonucleotide
tccctcactttcttcacccc

SEQ ID NO: 766 - DNA, 20 bp, Artificial sequence
  Synthetic oligonucleotide
cccaggtaaccaccttttga

SEQ ID NO: 767 - DNA, 20 bp, Artificial sequence
  Synthetic oligonucleotide
aaggtgccttatcagggttg

SEQ ID NO: 768 - DNA, 20 bp, Artificial sequence
  Synthetic oligonucleotide
tgtgggcttttgccttaact

SEQ ID NO: 769 - DNA, 20 bp, Artificial sequence
  Synthetic oligonucleotide
tacctgcctcagtctccctt

SEQ ID NO: 770 - DNA, 20 bp, Artificial sequence
  Synthetic oligonucleotide
aatcctttcctccctcccct

SEQ ID NO: 771 - DNA, 20 bp, Artificial sequence
  Synthetic oligonucleotide
tccccattcctcagccttgc

SEQ ID NO: 772 - DNA, 20 bp, Artificial sequence
  Synthetic oligonucleotide
tgtctctccctctctcagtt

SEQ ID NO: 773 - DNA, 20 bp, Artificial sequence
  Synthetic oligonucleotide
cttgtctctttccgtctccc

SEQ ID NO: 774 - DNA, 20 bp, Artificial sequence
  Synthetic oligonucleotide
gcaggctggcccacaggcag

SEQ ID NO: 775 - DNA, 20 bp, Artificial sequence
  Synthetic oligonucleotide
agaggatattctcccagctt

SEQ ID NO: 776 - DNA, 20 bp, Artificial sequence
  Synthetic oligonucleotide
gcacctacttcatagtaagg

SEQ ID NO: 777 - DNA, 20 bp, Artificial sequence
  Synthetic oligonucleotide
agttggaaatccaactctac

SEQ ID NO: 778 - DNA, 20 bp, Artificial sequence
  Synthetic oligonucleotide
agaggctcagtaacccaaaa

SEQ ID NO: 779 - DNA, 20 bp, Artificial sequence
  Synthetic oligonucleotide
cccctctacagtgtctttcc

SEQ ID NO: 780 - DNA, 20 bp, Artificial sequence
  Synthetic oligonucleotide
tggccctcccttcttctctt

SEQ ID NO: 781 - DNA, 20 bp, Artificial sequence
  Synthetic oligonucleotide
ggccctcaccctgctcagac

SEQ ID NO: 782 - DNA, 20 bp, Artificial sequence
  Synthetic oligonucleotide
cctcgcctggcctcaccctg

SEQ ID NO: 783 - DNA, 20 bp, Artificial sequence
  Synthetic oligonucleotide
actgtgacccatggatgcgg

SEQ ID NO: 784 - DNA, 20 bp, Artificial sequence
  Synthetic oligonucleotide
cgcccgtccccgtcctgccc

SEQ ID NO: 785 - DNA, 20 bp, Artificial sequence
  Synthetic oligonucleotide
tgaaaaagactcagtccctg

SEQ ID NO: 786 - DNA, 20 bp, Artificial sequence
  Synthetic oligonucleotide
attggttgaatccatccatc

SEQ ID NO: 787 - DNA, 20 bp, Artificial sequence
  Synthetic oligonucleotide
tcctagctttttccccagca

SEQ ID NO: 788 - DNA, 20 bp, Artificial sequence
  Synthetic oligonucleotide
cactaatatttaacattaag

SEQ ID NO: 789 - DNA, 20 bp, Artificial sequence
  Synthetic oligonucleotide
gacatgcatatctagtggtc

SEQ ID NO: 790 - DNA, 20 bp, Artificial sequence
  Synthetic oligonucleotide
ctttcctacttctctctgcc

SEQ ID NO: 791 - DNA, 20 bp, Artificial sequence
  Synthetic oligonucleotide
tgctcaatacacataggtcc

SEQ ID NO: 792 - DNA, 20 bp, Artificial sequence
  Synthetic oligonucleotide
gaagtcccaacttagccacc

SEQ ID NO: 793 - DNA, 20 bp, Artificial sequence
  Synthetic oligonucleotide
cctggctttctgaaaaccca

SEQ ID NO: 794 - DNA, 20 bp, Artificial sequence
  Synthetic oligonucleotide
ggctggagagcccccaaatc

SEQ ID NO: 795 - DNA, 20 bp, Artificial sequence
  Synthetic oligonucleotide
ggcttccccatcgcaccccc

SEQ ID NO: 796 - DNA, 20 bp, Artificial sequence
  Synthetic oligonucleotide
atccctccttacctctccat

SEQ ID NO: 797 - DNA, 20 bp, Artificial sequence
  Synthetic oligonucleotide
ccccaggctttcctccatgg

SEQ ID NO: 798 - DNA, 20 bp, Artificial sequence
  Synthetic oligonucleotide
ccttagaacagcctatggag

SEQ ID NO: 799 - DNA, 20 bp, Artificial sequence
  Synthetic oligonucleotide
tggtagtttccttttaccaa

SEQ ID NO: 800 - DNA, 20 bp, Artificial sequence
  Synthetic oligonucleotide
ggcggatacgccaaatcccc

SEQ ID NO: 801 - DNA, 20 bp, Artificial sequence
  Synthetic oligonucleotide
acagaccccaggtccaccac

SEQ ID NO: 802 - DNA, 20 bp, Artificial sequence
  Synthetic oligonucleotide
ggccccccaccatcatctcc

SEQ ID NO: 803 - DNA, 20 bp, Artificial sequence
  Synthetic oligonucleotide
gcattgagtgccccagccag

SEQ ID NO: 804 - DNA, 20 bp, Artificial sequence
  Synthetic oligonucleotide
ccctctcaacctccagccgg

SEQ ID NO: 805 - DNA, 20 bp, Artificial sequence
  Synthetic oligonucleotide
gcttccagcctcaggttggt

SEQ ID NO: 806 - DNA, 20 bp, Artificial sequence
  Synthetic oligonucleotide
tccagcgactcaatcttcct

SEQ ID NO: 807 - DNA, 20 bp, Artificial sequence
  Synthetic oligonucleotide
cgtcaagctccacatggacc

SEQ ID NO: 808 - DNA, 20 bp, Artificial sequence
  Synthetic oligonucleotide
aactggccgcctcccgcacg

SEQ ID NO: 809 - DNA, 20 bp, Artificial sequence
  Synthetic oligonucleotide
ggttggagaaggtctgcacg

SEQ ID NO: 810 - DNA, 20 bp, Artificial sequence
  Synthetic oligonucleotide
ccacgatgttcctcttgagg

SEQ ID NO: 811 - DNA, 20 bp, Artificial sequence
  Synthetic oligonucleotide
cttggactccttaatgacct

SEQ ID NO: 812 - DNA, 20 bp, Artificial sequence
  Synthetic oligonucleotide
gctcgggcccctcatgagac

SEQ ID NO: 813 - DNA, 20 bp, Artificial sequence
  Synthetic oligonucleotide
catgcccctccagactgccc

SEQ ID NO: 814 - DNA, 20 bp, Artificial sequence
  Synthetic oligonucleotide
cgccctcctccccttctctc

SEQ ID NO: 815 - DNA, 20 bp, Artificial sequence
  Synthetic oligonucleotide
ggcaacagtttccataacaa

SEQ ID NO: 816 - DNA, 20 bp, Artificial sequence
  Synthetic oligonucleotide
tgaggaaactcaaaggcaca

SEQ ID NO: 817 - DNA, 20 bp, Artificial sequence
  Synthetic oligonucleotide
cagggctaccttgtctgtgg

SEQ ID NO: 818 - DNA, 20 bp, Artificial sequence
  Synthetic oligonucleotide
atcttagactgatcagggtc

SEQ ID NO: 819 - DNA, 20 bp, Artificial sequence
  Synthetic oligonucleotide
agctcccacctgcccacagc

SEQ ID NO: 820 - DNA, 20 bp, Artificial sequence
  Synthetic oligonucleotide
cctcccagcacctcatccct

SEQ ID NO: 821 - DNA, 20 bp, Artificial sequence
  Synthetic oligonucleotide
tctctgtacccacagctggg

SEQ ID NO: 822 - DNA, 20 bp, Artificial sequence
  Synthetic oligonucleotide
cacaacccctacttgtatgc

SEQ ID NO: 823 - DNA, 20 bp, Artificial sequence
  Synthetic oligonucleotide
ttcagcatcttcaagaggat

SEQ ID NO: 824 - DNA, 20 bp, Artificial sequence
  Synthetic oligonucleotide
ccatggatacatcccctttc

SEQ ID NO: 825 - DNA, 20 bp, Artificial sequence
  Synthetic oligonucleotide
ccagtgtcttcactttgctc

SEQ ID NO: 826 - DNA, 20 bp, Artificial sequence
  Synthetic oligonucleotide
cagtctgctcaccagtctgc

SEQ ID NO: 827 - DNA, 20 bp, Artificial sequence
  Synthetic oligonucleotide
tgggccctcccagtcccatc

SEQ ID NO: 828 - DNA, 20 bp, Artificial sequence
  Synthetic oligonucleotide
ggaaaggacaccaagtcttg

SEQ ID NO: 829 - DNA, 20 bp, Artificial sequence
  Synthetic oligonucleotide
atttgtctttatttttcctc

SEQ ID NO: 830 - DNA, 20 bp, Artificial sequence
  Synthetic oligonucleotide
tgtgattttccccgtctttg

SEQ ID NO: 831 - DNA, 20 bp, Artificial sequence
  Synthetic oligonucleotide
ggtgaggctcactccctgtc

SEQ ID NO: 832 - DNA, 20 bp, Artificial sequence
  Synthetic oligonucleotide
caccacctttaccactaaca

SEQ ID NO: 833 - DNA, 20 bp, Artificial sequence
  Synthetic oligonucleotide
ctgcttgctcagaggcccca

SEQ ID NO: 834 - DNA, 20 bp, Artificial sequence
  Synthetic oligonucleotide
ctgacctcgaatctgcaggt

SEQ ID NO: 835 - DNA, 20 bp, Artificial sequence
  Synthetic oligonucleotide
gggcaggactccagtgccct

SEQ ID NO: 836 - DNA, 20 bp, Artificial sequence
  Synthetic oligonucleotide
ctggatccctttgccctgat

SEQ ID NO: 837 - DNA, 20 bp, Artificial sequence
  Synthetic oligonucleotide
cacccagttctgctgtcgaa

SEQ ID NO: 838 - DNA, 20 bp, Artificial sequence
  Synthetic oligonucleotide
caaaaacagaaaacactcag

SEQ ID NO: 839 - DNA, 20 bp, Artificial sequence
  Synthetic oligonucleotide
acaaggccccccttccccat

SEQ ID NO: 840 - DNA, 20 bp, Artificial sequence
  Synthetic oligonucleotide
cactgctttccccagtaggg

SEQ ID NO: 841 - DNA, 20 bp, Artificial sequence
  Synthetic oligonucleotide
ctcctcctttatatggacac

SEQ ID NO: 842 - DNA, 20 bp, Artificial sequence
  Synthetic oligonucleotide
cctcatggacatcaaccttc

SEQ ID NO: 843 - DNA, 20 bp, Artificial sequence
  Synthetic oligonucleotide
ttccctcactttcttcaccc

SEQ ID NO: 844 - DNA, 20 bp, Artificial sequence
  Synthetic oligonucleotide
tcccaggtaaccaccttttg

SEQ ID NO: 845 - DNA, 20 bp, Artificial sequence
  Synthetic oligonucleotide
ctaaggtgccttatcagggt

SEQ ID NO: 846 - DNA, 20 bp, Artificial sequence
  Synthetic oligonucleotide
acccaggaccagtagagcag

SEQ ID NO: 847 - DNA, 20 bp, Artificial sequence
  Synthetic oligonucleotide
aatacctgcctcagtctccc

SEQ ID NO: 848 - DNA, 20 bp, Artificial sequence
  Synthetic oligonucleotide
caatcctttcctccctcccc

SEQ ID NO: 849 - DNA, 20 bp, Artificial sequence
  Synthetic oligonucleotide
ctccccattcctcagccttg

SEQ ID NO: 850 - DNA, 20 bp, Artificial sequence
  Synthetic oligonucleotide
ctcagcttctctgtctctgt

SEQ ID NO: 851 - DNA, 20 bp, Artificial sequence
  Synthetic oligonucleotide
cccctcggccaggagttcga

SEQ ID NO: 852 - DNA, 20 bp, Artificial sequence
  Synthetic oligonucleotide
ccccattctcttgtacagag

SEQ ID NO: 853 - DNA, 20 bp, Artificial sequence
  Synthetic oligonucleotide
gagaggatattctcccagct

SEQ ID NO: 854 - DNA, 20 bp, Artificial sequence
  Synthetic oligonucleotide
aagaacagcacctacttcat

SEQ ID NO: 855 - DNA, 20 bp, Artificial sequence
  Synthetic oligonucleotide
gagttggaaatccaactcta

SEQ ID NO: 856 - DNA, 20 bp, Artificial sequence
  Synthetic oligonucleotide
gtagaggctcagtaacccaa

SEQ ID NO: 857 - DNA, 20 bp, Artificial sequence
  Synthetic oligonucleotide
atgccccctctacagtgtct

SEQ ID NO: 858 - DNA, 20 bp, Artificial sequence
  Synthetic oligonucleotide
aatggccctcccttcttctc

SEQ ID NO: 859 - DNA, 20 bp, Artificial sequence
  Synthetic oligonucleotide
ccatcgggccctcaccctgc

SEQ ID NO: 860 - DNA, 20 bp, Artificial sequence
  Synthetic oligonucleotide
accttccacactgacagctg

SEQ ID NO: 861 - DNA, 20 bp, Artificial sequence
  Synthetic oligonucleotide
caactgtgacccatggatgc

SEQ ID NO: 862 - DNA, 20 bp, Artificial sequence
  Synthetic oligonucleotide
ctgctccgcccgtccccgtc

SEQ ID NO: 863 - DNA, 20 bp, Artificial sequence
  Synthetic oligonucleotide
ctgaaaaagactcagtccct

SEQ ID NO: 864 - DNA, 20 bp, Artificial sequence
  Synthetic oligonucleotide
atattggttgaatccatcca

SEQ ID NO: 865 - DNA, 20 bp, Artificial sequence
  Synthetic oligonucleotide
tctaactccatctcctagct

SEQ ID NO: 866 - DNA, 20 bp, Artificial sequence
  Synthetic oligonucleotide
tcactaatatttaacattaa

SEQ ID NO: 867 - DNA, 20 bp, Artificial sequence
  Synthetic oligonucleotide
gctgaattaagtcctgagac

SEQ ID NO: 868 - DNA, 20 bp, Artificial sequence
  Synthetic oligonucleotide
tctttcctacttctctctgc

SEQ ID NO: 869 - DNA, 20 bp, Artificial sequence
  Synthetic oligonucleotide
aggctgttaaacatgtggca

SEQ ID NO: 870 - DNA, 20 bp, Artificial sequence
  Synthetic oligonucleotide
agaagtcccaacttagccac

SEQ ID NO: 871 - DNA, 20 bp, Artificial sequence
  Synthetic oligonucleotide
acctggctttctgaaaaccc

SEQ ID NO: 872 - DNA, 20 bp, Artificial sequence
  Synthetic oligonucleotide
aggctcttccaaacgggctg

SEQ ID NO: 873 - DNA, 20 bp, Artificial sequence
  Synthetic oligonucleotide
ccggcttccccatcgcaccc

SEQ ID NO: 874 - DNA, 20 bp, Artificial sequence
  Synthetic oligonucleotide
aatccctccttacctctcca

SEQ ID NO: 875 - DNA, 20 bp, Artificial sequence
  Synthetic oligonucleotide
tgccagccccaggctttcct

SEQ ID NO: 876 - DNA, 20 bp, Artificial sequence
  Synthetic oligonucleotide
ctccccttagaacagcctat

SEQ ID NO: 877 - DNA, 20 bp, Artificial sequence
  Synthetic oligonucleotide
ctggtagtttccttttacca

SEQ ID NO: 878 - DNA, 20 bp, Artificial sequence
  Synthetic oligonucleotide
tggcggatacgccaaatccc

SEQ ID NO: 879 - DNA, 20 bp, Artificial sequence
  Synthetic oligonucleotide
gagttcacacagaccccagg

SEQ ID NO: 880 - DNA, 20 bp, Artificial sequence
  Synthetic oligonucleotide
aggccccccaccatcatctc

SEQ ID NO: 881 - DNA, 20 bp, Artificial sequence
  Synthetic oligonucleotide
cagcattgagtgccccagcc

SEQ ID NO: 882 - DNA, 20 bp, Artificial sequence
  Synthetic oligonucleotide
tccctctcaacctccagccg

SEQ ID NO: 883 - DNA, 20 bp, Artificial sequence
  Synthetic oligonucleotide
ggcttccagcctcaggttgg

SEQ ID NO: 884 - DNA, 20 bp, Artificial sequence
  Synthetic oligonucleotide
ctccagcgactcaatcttcc

SEQ ID NO: 885 - DNA, 20 bp, Artificial sequence
  Synthetic oligonucleotide
gatctctttcagggctgcgg

SEQ ID NO: 886 - DNA, 20 bp, Artificial sequence
  Synthetic oligonucleotide
ataactggccgcctcccgca

SEQ ID NO: 887 - DNA, 20 bp, Artificial sequence
  Synthetic oligonucleotide
ggtttctcgaatctgcaggt

SEQ ID NO: 888 - DNA, 20 bp, Artificial sequence
  Synthetic oligonucleotide
cttcaccacgatgttcctct

SEQ ID NO: 889 - DNA, 20 bp, Artificial sequence
  Synthetic oligonucleotide
gcttggactccttaatgacc

SEQ ID NO: 890 - DNA, 20 bp, Artificial sequence
  Synthetic oligonucleotide
tgctcgggcccctcatgaga

SEQ ID NO: 891 - DNA, 20 bp, Artificial sequence
  Synthetic oligonucleotide
ccatgcccctccagactgcc

SEQ ID NO: 892 - DNA, 20 bp, Artificial sequence
  Synthetic oligonucleotide
ccgccctcctccccttctct

SEQ ID NO: 893 - DNA, 20 bp, Artificial sequence
  Synthetic oligonucleotide
tctggcaacagtttccataa

SEQ ID NO: 894 - DNA, 20 bp, Artificial sequence
  Synthetic oligonucleotide
ctgaggaaactcaaaggcac

SEQ ID NO: 895 - DNA, 20 bp, Artificial sequence
  Synthetic oligonucleotide
gccagggctaccttgtctgt

SEQ ID NO: 896 - DNA, 20 bp, Artificial sequence
  Synthetic oligonucleotide
catcttagactgatcagggt

SEQ ID NO: 897 - DNA, 20 bp, Artificial sequence
  Synthetic oligonucleotide
caagctcccacctgcccaca

SEQ ID NO: 898 - DNA, 20 bp, Artificial sequence
  Synthetic oligonucleotide
tctatccctcccagcacctc

SEQ ID NO: 899 - DNA, 20 bp, Artificial sequence
  Synthetic oligonucleotide
ctctctgtacccacagctgg

SEQ ID NO: 900 - DNA, 20 bp, Artificial sequence
  Synthetic oligonucleotide
ccacaacccctacttgtatg

SEQ ID NO: 901 - DNA, 20 bp, Artificial sequence
  Synthetic oligonucleotide
tttcagcatcttcaagagga

SEQ ID NO: 902 - DNA, 20 bp, Artificial sequence
  Synthetic oligonucleotide
cccatggatacatccccttt

SEQ ID NO: 903 - DNA, 20 bp, Artificial sequence
  Synthetic oligonucleotide
agccagtgtcttcactttgc

SEQ ID NO: 904 - DNA, 20 bp, Artificial sequence
  Synthetic oligonucleotide
gatcccaccagtctgctcac

SEQ ID NO: 905 - DNA, 20 bp, Artificial sequence
  Synthetic oligonucleotide
gtgggccctcccagtcccat

SEQ ID NO: 906 - DNA, 20 bp, Artificial sequence
  Synthetic oligonucleotide
tgccctgaagattagcagca

SEQ ID NO: 907 - DNA, 20 bp, Artificial sequence
  Synthetic oligonucleotide
catttgtctttatttttcct

SEQ ID NO: 908 - DNA, 20 bp, Artificial sequence
  Synthetic oligonucleotide
ttgtgattttccccgtcttt

SEQ ID NO: 909 - DNA, 20 bp, Artificial sequence
  Synthetic oligonucleotide
acgcagtccaggccctttag

SEQ ID NO: 910 - DNA, 20 bp, Artificial sequence
  Synthetic oligonucleotide
ctcaccacctttaccactaa

SEQ ID NO: 911 - DNA, 20 bp, Artificial sequence
  Synthetic oligonucleotide
agaggtgagacagaggctgc

SEQ ID NO: 912 - DNA, 20 bp, Artificial sequence
  Synthetic oligonucleotide
tactgacctcgaatctgcag

SEQ ID NO: 913 - DNA, 20 bp, Artificial sequence
  Synthetic oligonucleotide
cctacaggccctggaggagg

SEQ ID NO: 914 - DNA, 20 bp, Artificial sequence
  Synthetic oligonucleotide
agctggatccctttgccctg

SEQ ID NO: 915 - DNA, 20 bp, Artificial sequence
  Synthetic oligonucleotide
ctctcacccagttctgctgt

SEQ ID NO: 916 - DNA, 20 bp, Artificial sequence
  Synthetic oligonucleotide
ccctgtagtgacaagcagtt

SEQ ID NO: 917 - DNA, 20 bp, Artificial sequence
  Synthetic oligonucleotide
ccttctgctcacaaggcccc

SEQ ID NO: 918 - DNA, 20 bp, Artificial sequence
  Synthetic oligonucleotide
aagcccagccatgaatgaaa

SEQ ID NO: 919 - DNA, 20 bp, Artificial sequence
  Synthetic oligonucleotide
aactcctcctttatatggac

SEQ ID NO: 920 - DNA, 20 bp, Artificial sequence
  Synthetic oligonucleotide
ccaatctccctcatggacat

SEQ ID NO: 921 - DNA, 20 bp, Artificial sequence
  Synthetic oligonucleotide
ctgctctttccctcactttc

SEQ ID NO: 922 - DNA, 20 bp, Artificial sequence
  Synthetic oligonucleotide
atcccaggtaaccacctttt

SEQ ID NO: 923 - DNA, 20 bp, Artificial sequence
  Synthetic oligonucleotide
actaaggtgccttatcaggg

SEQ ID NO: 924 - DNA, 20 bp, Artificial sequence
  Synthetic oligonucleotide
cacccaggaccagtagagca

SEQ ID NO: 925 - DNA, 20 bp, Artificial sequence
  Synthetic oligonucleotide
acttgaatacctgcctcagt

SEQ ID NO: 926 - DNA, 20 bp, Artificial sequence
  Synthetic oligonucleotide
atcaatcctttcctccctcc

SEQ ID NO: 927 - DNA, 20 bp, Artificial sequence
  Synthetic oligonucleotide
cttctccccattcctcagcc

SEQ ID NO: 928 - DNA, 20 bp, Artificial sequence
  Synthetic oligonucleotide
agtgtctctctcagtctcag

SEQ ID NO: 929 - DNA, 20 bp, Artificial sequence
  Synthetic oligonucleotide
ctcttctgcctgcccctcgg

SEQ ID NO: 930 - DNA, 20 bp, Artificial sequence
  Synthetic oligonucleotide
tcccccattctcttgtacag

SEQ ID NO: 931 - DNA, 20 bp, Artificial sequence
  Synthetic oligonucleotide
ggagaggatattctcccagc

SEQ ID NO: 932 - DNA, 20 bp, Artificial sequence
  Synthetic oligonucleotide
ctgtcaaagaacagcaccta

SEQ ID NO: 933 - DNA, 20 bp, Artificial sequence
  Synthetic oligonucleotide
agagttggaaatccaactct

SEQ ID NO: 934 - DNA, 20 bp, Artificial sequence
  Synthetic oligonucleotide
ggtcagacacctctctgtgt

SEQ ID NO: 935 - DNA, 20 bp, Artificial sequence
  Synthetic oligonucleotide
gcctagcccaaatgccccct

SEQ ID NO: 936 - DNA, 20 bp, Artificial sequence
  Synthetic oligonucleotide
gctctgtcctccactaggaa

SEQ ID NO: 937 - DNA, 20 bp, Artificial sequence
  Synthetic oligonucleotide
cccatcgggccctcaccctg

SEQ ID NO: 938 - DNA, 20 bp, Artificial sequence
  Synthetic oligonucleotide
agaaccttccacactgacag

SEQ ID NO: 939 - DNA, 20 bp, Artificial sequence
  Synthetic oligonucleotide
aacaactgtgacccatggat

SEQ ID NO: 940 - DNA, 20 bp, Artificial sequence
  Synthetic oligonucleotide
ccctgctccgcccgtccccg

SEQ ID NO: 941 - DNA, 20 bp, Artificial sequence
  Synthetic oligonucleotide
gctgaaaaagactcagtccc

SEQ ID NO: 942 - DNA, 20 bp, Artificial sequence
  Synthetic oligonucleotide
gtccttggccttgaggccta

SEQ ID NO: 943 - DNA, 20 bp, Artificial sequence
  Synthetic oligonucleotide
agtctaactccatctcctag

SEQ ID NO: 944 - DNA, 20 bp, Artificial sequence
  Synthetic oligonucleotide
cattcactaatatttaacat

SEQ ID NO: 945 - DNA, 20 bp, Artificial sequence
  Synthetic oligonucleotide
gttagcctttctgatgctga

SEQ ID NO: 946 - DNA, 20 bp, Artificial sequence
  Synthetic oligonucleotide
ctctttcctacttctctctg

SEQ ID NO: 947 - DNA, 20 bp, Artificial sequence
  Synthetic oligonucleotide
ggcctacttctctaggtggg

SEQ ID NO: 948 - DNA, 20 bp, Artificial sequence
  Synthetic oligonucleotide
aagaagtcccaacttagcca

SEQ ID NO: 949 - DNA, 20 bp, Artificial sequence
  Synthetic oligonucleotide
cctctgcaagccctggcctg

SEQ ID NO: 950 - DNA, 20 bp, Artificial sequence
  Synthetic oligonucleotide
taggctcttccaaacgggct

SEQ ID NO: 951 - DNA, 20 bp, Artificial sequence
  Synthetic oligonucleotide
cccggcttccccatcgcacc

SEQ ID NO: 952 - DNA, 20 bp, Artificial sequence
  Synthetic oligonucleotide
ccaaatccctccttacctct

SEQ ID NO: 953 - DNA, 20 bp, Artificial sequence
  Synthetic oligonucleotide
ggaaccttctatgtgccagc

SEQ ID NO: 954 - DNA, 20 bp, Artificial sequence
  Synthetic oligonucleotide
gctttggtaccaaggctccc

SEQ ID NO: 955 - DNA, 20 bp, Artificial sequence
  Synthetic oligonucleotide
cctggtagtttccttttacc

SEQ ID NO: 956 - DNA, 20 bp, Artificial sequence
  Synthetic oligonucleotide
gctggagtaagatgagctcc

SEQ ID NO: 957 - DNA, 20 bp, Artificial sequence
  Synthetic oligonucleotide
cagtgcaacagttaggagtt

SEQ ID NO: 958 - DNA, 20 bp, Artificial sequence
  Synthetic oligonucleotide
caggccccccaccatcatct

SEQ ID NO: 959 - DNA, 20 bp, Artificial sequence
  Synthetic oligonucleotide
ccttgaagccagcattgagt

SEQ ID NO: 960 - DNA, 20 bp, Artificial sequence
  Synthetic oligonucleotide
gtccctctcaacctccagcc

SEQ ID NO: 961 - DNA, 20 bp, Artificial sequence
  Synthetic oligonucleotide
ctcggcttccagcctcaggt

SEQ ID NO: 962 - DNA, 20 bp, Artificial sequence
  Synthetic oligonucleotide
tcctcctccagcgactcaat

SEQ ID NO: 963 - DNA, 20 bp, Artificial sequence
  Synthetic oligonucleotide
gtgcggatctctttcagggc

SEQ ID NO: 964 - DNA, 20 bp, Artificial sequence
  Synthetic oligonucleotide
gataactggccgcctcccgc

SEQ ID NO: 965 - DNA, 20 bp, Artificial sequence
  Synthetic oligonucleotide
ctggtttctcgaatctgcag

SEQ ID NO: 966 - DNA, 20 bp, Artificial sequence
  Synthetic oligonucleotide
ggtcttcaccacgatgttcc

SEQ ID NO: 967 - DNA, 20 bp, Artificial sequence
  Synthetic oligonucleotide
cacatcacatccttgtgctc

SEQ ID NO: 968 - DNA, 20 bp, Artificial sequence
  Synthetic oligonucleotide
tctgctcgggcccctcatga

SEQ ID NO: 969 - DNA, 20 bp, Artificial sequence
  Synthetic oligonucleotide
gccatgcccctccagactgc

SEQ ID NO: 970 - DNA, 20 bp, Artificial sequence
  Synthetic oligonucleotide
cccgccctcctccccttctc

SEQ ID NO: 971 - DNA, 20 bp, Artificial sequence
  Synthetic oligonucleotide
tctctggcaacagtttccat

SEQ ID NO: 972 - DNA, 20 bp, Artificial sequence
  Synthetic oligonucleotide
cctgaggaaactcaaaggca

SEQ ID NO: 973 - DNA, 20 bp, Artificial sequence
  Synthetic oligonucleotide
ggccagggctaccttgtctg

SEQ ID NO: 974 - DNA, 20 bp, Artificial sequence
  Synthetic oligonucleotide
ccatcttagactgatcaggg

SEQ ID NO: 975 - DNA, 20 bp, Artificial sequence
  Synthetic oligonucleotide
tcaagctcccacctgcccac

SEQ ID NO: 976 - DNA, 20 bp, Artificial sequence
  Synthetic oligonucleotide
ctctatccctcccagcacct

SEQ ID NO: 977 - DNA, 20 bp, Artificial sequence
  Synthetic oligonucleotide
cctctctgtacccacagctg

SEQ ID NO: 978 - DNA, 20 bp, Artificial sequence
  Synthetic oligonucleotide
cccacaacccctacttgtat

SEQ ID NO: 979 - DNA, 20 bp, Artificial sequence
  Synthetic oligonucleotide
ctcctgtttcagcatcttca

SEQ ID NO: 980 - DNA, 20 bp, Artificial sequence
  Synthetic oligonucleotide
ccccatggatacatcccctt

SEQ ID NO: 981 - DNA, 20 bp, Artificial sequence
  Synthetic oligonucleotide
ggaatatgagccagtgtctt

SEQ ID NO: 982 - DNA, 20 bp, Artificial sequence
  Synthetic oligonucleotide
cagatcccaccagtctgctc

SEQ ID NO: 983 - DNA, 20 bp, Artificial sequence
  Synthetic oligonucleotide
gaagtgggccctcccagtcc

SEQ ID NO: 984 - DNA, 20 bp, Artificial sequence
  Synthetic oligonucleotide
gtgccctgaagattagcagc

SEQ ID NO: 985 - DNA, 20 bp, Artificial sequence
  Synthetic oligonucleotide
gcatttgtctttatttttcc

SEQ ID NO: 986 - DNA, 20 bp, Artificial sequence
  Synthetic oligonucleotide
cttgtgattttccccgtctt

SEQ ID NO: 987 - DNA, 20 bp, Artificial sequence
  Synthetic oligonucleotide
atgacgcagtccaggccctt

SEQ ID NO: 988 - DNA, 20 bp, Artificial sequence
  Synthetic oligonucleotide
actcaccacctttaccacta

SEQ ID NO: 989 - DNA, 20 bp, Artificial sequence
  Synthetic oligonucleotide
aagaggtgagacagaggctg

SEQ ID NO: 990 - DNA, 20 bp, Artificial sequence
  Synthetic oligonucleotide
gtactgacctcgaatctgca

SEQ ID NO: 991 - DNA, 20 bp, Artificial sequence
  Synthetic oligonucleotide
agcaacctacaggccctgga

SEQ ID NO: 992 - DNA, 20 bp, Artificial sequence
  Synthetic oligonucleotide
gagctggatccctttgccct

SEQ ID NO: 993 - DNA, 20 bp, Artificial sequence
  Synthetic oligonucleotide
gctctcacccagttctgctg

SEQ ID NO: 994 - DNA, 20 bp, Artificial sequence
  Synthetic oligonucleotide
ccccctgtagtgacaagcag

SEQ ID NO: 995 - DNA, 20 bp, Artificial sequence
  Synthetic oligonucleotide
gaggttcggcccctccctga

SEQ ID NO: 996 - DNA, 20 bp, Artificial sequence
  Synthetic oligonucleotide
aaagcccagccatgaatgaa

SEQ ID NO: 997 - DNA, 20 bp, Artificial sequence
  Synthetic oligonucleotide
caactcctcctttatatgga

SEQ ID NO: 998 - DNA, 20 bp, Artificial sequence
  Synthetic oligonucleotide
atccaatctccctcatggac

SEQ ID NO: 999 - DNA, 20 bp, Artificial sequence
  Synthetic oligonucleotide
gcctgctctttccctcactt

SEQ ID NO: 1000 - DNA, 20 bp, Artificial sequence
  Synthetic oligonucleotide
tctgatcccaggtaaccacc

SEQ ID NO: 1001 - DNA, 20 bp, Artificial sequence
  Synthetic oligonucleotide
tactaaggtgccttatcagg

SEQ ID NO: 1002 - DNA, 20 bp, Artificial sequence
  Synthetic oligonucleotide
acccccacccaggaccagta

SEQ ID NO: 1003 - DNA, 20 bp, Artificial sequence
  Synthetic oligonucleotide
gacacttgaatacctgcctc

SEQ ID NO: 1004 - DNA, 20 bp, Artificial sequence
  Synthetic oligonucleotide
catcaatcctttcctccctc

SEQ ID NO: 1005 - DNA, 20 bp, Artificial sequence
  Synthetic oligonucleotide
tccttctccccattcctcag

SEQ ID NO: 1006 - DNA, 20 bp, Artificial sequence
  Synthetic oligonucleotide
tctctgagtgtctctctcag

SEQ ID NO: 1007 - DNA, 20 bp, Artificial sequence
  Synthetic oligonucleotide
cctcttctgcctgcccctcg

SEQ ID NO: 1008 - DNA, 20 bp, Artificial sequence
  Synthetic oligonucleotide
ttcccccattctcttgtaca

SEQ ID NO: 1009 - DNA, 20 bp, Artificial sequence
  Synthetic oligonucleotide
ggtgaaagtcagtcacctgg

SEQ ID NO: 1010 - DNA, 20 bp, Artificial sequence
  Synthetic oligonucleotide
atctgtcaaagaacagcacc

SEQ ID NO: 1011 - DNA, 20 bp, Artificial sequence
  Synthetic oligonucleotide
tagagttggaaatccaactc

SEQ ID NO: 1012 - DNA, 20 bp, Artificial sequence
  Synthetic oligonucleotide
acaccttccaggtcagacac

SEQ ID NO: 1013 - DNA, 20 bp, Artificial sequence
  Synthetic oligonucleotide
tgcctagcccaaatgccccc

SEQ ID NO: 1014 - DNA, 20 bp, Artificial sequence
  Synthetic oligonucleotide
aggctctgtcctccactagg

SEQ ID NO: 1015 - DNA, 20 bp, Artificial sequence
  Synthetic oligonucleotide
cctcccagccccatcgggcc

SEQ ID NO: 1016 - DNA, 20 bp, Artificial sequence
  Synthetic oligonucleotide
cagaaccttccacactgaca

SEQ ID NO: 1017 - DNA, 20 bp, Artificial sequence
  Synthetic oligonucleotide
ttcccaacaactgtgaccca

SEQ ID NO: 1018 - DNA, 20 bp, Artificial sequence
  Synthetic oligonucleotide
tggcccttctcccctggcat

SEQ ID NO: 1019 - DNA, 20 bp, Artificial sequence
  Synthetic oligonucleotide
aaggctgaaaaagactcagt

SEQ ID NO: 1020 - DNA, 20 bp, Artificial sequence
  Synthetic oligonucleotide
gtgacccaagtccttggcct

SEQ ID NO: 1021 - DNA, 20 bp, Artificial sequence
  Synthetic oligonucleotide
ggaaagtctaactccatctc

SEQ ID NO: 1022 - DNA, 20 bp, Artificial sequence
  Synthetic oligonucleotide
acattcactaatatttaaca

SEQ ID NO: 1023 - DNA, 20 bp, Artificial sequence
  Synthetic oligonucleotide
ctggttagcctttctgatgc

SEQ ID NO: 1024 - DNA, 20 bp, Artificial sequence
  Synthetic oligonucleotide
tcctctttcctacttctctc

SEQ ID NO: 1025 - DNA, 20 bp, Artificial sequence
  Synthetic oligonucleotide
gggcctacttctctaggtgg

SEQ ID NO: 1026 - DNA, 20 bp, Artificial sequence
  Synthetic oligonucleotide
agctcaagaagtcccaactt

SEQ ID NO: 1027 - DNA, 20 bp, Artificial sequence
  Synthetic oligonucleotide
gcttcatttcagcccctctg

SEQ ID NO: 1028 - DNA, 20 bp, Artificial sequence
  Synthetic oligonucleotide
ctaggctcttccaaacgggc

SEQ ID NO: 1029 - DNA, 20 bp, Artificial sequence
  Synthetic oligonucleotide
tgcccggcttccccatcgca

SEQ ID NO: 1030 - DNA, 20 bp, Artificial sequence
  Synthetic oligonucleotide
gcccaaatccctccttacct

SEQ ID NO: 1031 - DNA, 20 bp, Artificial sequence
  Synthetic oligonucleotide
gctgggaaccttctatgtgc

SEQ ID NO: 1032 - DNA, 20 bp, Artificial sequence
  Synthetic oligonucleotide
ggctttggtaccaaggctcc

SEQ ID NO: 1033 - DNA, 20 bp, Artificial sequence
  Synthetic oligonucleotide
cccctggtagtttcctttta

SEQ ID NO: 1034 - DNA, 20 bp, Artificial sequence
  Synthetic oligonucleotide
tggtgagataacactgggaa

SEQ ID NO: 1035 - DNA, 20 bp, Artificial sequence
  Synthetic oligonucleotide
acagtgcaacagttaggagt

SEQ ID NO: 1036 - DNA, 20 bp, Artificial sequence
  Synthetic oligonucleotide
ccaggccccccaccatcatc

SEQ ID NO: 1037 - DNA, 20 bp, Artificial sequence
  Synthetic oligonucleotide
ctccttgaagccagcattga

SEQ ID NO: 1038 - DNA, 20 bp, Artificial sequence
  Synthetic oligonucleotide
tgtccctctcaacctccagc

SEQ ID NO: 1039 - DNA, 20 bp, Artificial sequence
  Synthetic oligonucleotide
ttctcggcttccagcctcag

SEQ ID NO: 1040 - DNA, 20 bp, Artificial sequence
  Synthetic oligonucleotide
atctcctcctccagcgactc

SEQ ID NO: 1041 - DNA, 20 bp, Artificial sequence
  Synthetic oligonucleotide
acgccattgcctcatactgc

SEQ ID NO: 1042 - DNA, 20 bp, Artificial sequence
  Synthetic oligonucleotide
tgataactggccgcctcccg

SEQ ID NO: 1043 - DNA, 20 bp, Artificial sequence
  Synthetic oligonucleotide
ggctggtttctcgaatctgc

SEQ ID NO: 1044 - DNA, 20 bp, Artificial sequence
  Synthetic oligonucleotide
acggtcttcaccacgatgtt

SEQ ID NO: 1045 - DNA, 20 bp, Artificial sequence
  Synthetic oligonucleotide
tcacatcacatccttgtgct

SEQ ID NO: 1046 - DNA, 20 bp, Artificial sequence
  Synthetic oligonucleotide
atcctgcttctgctcgggcc

SEQ ID NO: 1047 - DNA, 20 bp, Artificial sequence
  Synthetic oligonucleotide
tggccatgcccctccagact

SEQ ID NO: 1048 - DNA, 20 bp, Artificial sequence
  Synthetic oligonucleotide
ccccgccctcctccccttct

SEQ ID NO: 1049 - DNA, 20 bp, Artificial sequence
  Synthetic oligonucleotide
atctctggcaacagtttcca

SEQ ID NO: 1050 - DNA, 20 bp, Artificial sequence
  Synthetic oligonucleotide
gcctgaggaaactcaaaggc

SEQ ID NO: 1051 - DNA, 20 bp, Artificial sequence
  Synthetic oligonucleotide
tggccagggctaccttgtct

SEQ ID NO: 1052 - DNA, 20 bp, Artificial sequence
  Synthetic oligonucleotide
ccccacccatcttagactga

SEQ ID NO: 1053 - DNA, 20 bp, Artificial sequence
  Synthetic oligonucleotide
aatcaagctcccacctgccc

SEQ ID NO: 1054 - DNA, 20 bp, Artificial sequence
  Synthetic oligonucleotide
cctctatccctcccagcacc

SEQ ID NO: 1055 - DNA, 20 bp, Artificial sequence
  Synthetic oligonucleotide
cttgacctctctgtacccac

SEQ ID NO: 1056 - DNA, 20 bp, Artificial sequence
  Synthetic oligonucleotide
cacccacaacccctacttgt

SEQ ID NO: 1057 - DNA, 20 bp, Artificial sequence
  Synthetic oligonucleotide
tctcctgtttcagcatcttc

SEQ ID NO: 1058 - DNA, 20 bp, Artificial sequence
  Synthetic oligonucleotide
ccctgcccccatggatacat

SEQ ID NO: 1059 - DNA, 20 bp, Artificial sequence
  Synthetic oligonucleotide
gctgcaggaatatgagccag

SEQ ID NO: 1060 - DNA, 20 bp, Artificial sequence
  Synthetic oligonucleotide
acagatcccaccagtctgct

SEQ ID NO: 1061 - DNA, 20 bp, Artificial sequence
  Synthetic oligonucleotide
tgaagtgggccctcccagtc

SEQ ID NO: 1062 - DNA, 20 bp, Artificial sequence
  Synthetic oligonucleotide
cagcagtgccctgaagatta

SEQ ID NO: 1063 - DNA, 20 bp, Artificial sequence
  Synthetic oligonucleotide
agcatttgtctttatttttc

SEQ ID NO: 1064 - DNA, 20 bp, Artificial sequence
  Synthetic oligonucleotide
ccttgtgattttccccgtct

SEQ ID NO: 1065 - DNA, 20 bp, Artificial sequence
  Synthetic oligonucleotide
tacagttactctgtaccacg

SEQ ID NO: 1066 - DNA, 20 bp, Artificial sequence
  Synthetic oligonucleotide
gactcaccacctttaccact

SEQ ID NO: 1067 - DNA, 20 bp, Artificial sequence
  Synthetic oligonucleotide
gatgaaagaataaagcagag

SEQ ID NO: 1068 - DNA, 20 bp, Artificial sequence
  Synthetic oligonucleotide
tgtactgacctcgaatctgc

SEQ ID NO: 1069 - DNA, 20 bp, Artificial sequence
  Synthetic oligonucleotide
ggagcaacctacaggccctg

SEQ ID NO: 1070 - DNA, 20 bp, Artificial sequence
  Synthetic oligonucleotide
agagctggatccctttgccc

SEQ ID NO: 1071 - DNA, 20 bp, Artificial sequence
  Synthetic oligonucleotide
agctctcacccagttctgct

SEQ ID NO: 1072 - DNA, 20 bp, Artificial sequence
  Synthetic oligonucleotide
cttttgccccctgtagtgac

SEQ ID NO: 1073 - DNA, 20 bp, Artificial sequence
  Synthetic oligonucleotide
gtgccccatcaagaggtagg

SEQ ID NO: 1074 - DNA, 20 bp, Artificial sequence
  Synthetic oligonucleotide
acaaagcccagccatgaatg

SEQ ID NO: 1075 - DNA, 20 bp, Artificial sequence
  Synthetic oligonucleotide
ccaactcctcctttatatgg

SEQ ID NO: 1076 - DNA, 20 bp, Artificial sequence
  Synthetic oligonucleotide
aatccaatctccctcatgga

SEQ ID NO: 1077 - DNA, 20 bp, Artificial sequence
  Synthetic oligonucleotide
ctgcctgctctttccctcac

SEQ ID NO: 1078 - DNA, 20 bp, Artificial sequence
  Synthetic oligonucleotide
ctctgatcccaggtaaccac

SEQ ID NO: 1079 - DNA, 20 bp, Artificial sequence
  Synthetic oligonucleotide
aactcattactaaggtgcct

SEQ ID NO: 1080 - DNA, 20 bp, Artificial sequence
  Synthetic oligonucleotide
cacccccacccaggaccagt

SEQ ID NO: 1081 - DNA, 20 bp, Artificial sequence
  Synthetic oligonucleotide
ggacacttgaatacctgcct

SEQ ID NO: 1082 - DNA, 20 bp, Artificial sequence
  Synthetic oligonucleotide
ccatcaatcctttcctccct

SEQ ID NO: 1083 - DNA, 20 bp, Artificial sequence
  Synthetic oligonucleotide
ggctccttctccccattcct

SEQ ID NO: 1084 - DNA, 20 bp, Artificial sequence
  Synthetic oligonucleotide
tgtttctctcctctctctga

SEQ ID NO: 1085 - DNA, 20 bp, Artificial sequence
  Synthetic oligonucleotide
ttgtgtcctcttctgcctgc

SEQ ID NO: 1086 - DNA, 20 bp, Artificial sequence
  Synthetic oligonucleotide
ccttcccccattctcttgta

SEQ ID NO: 1087 - DNA, 20 bp, Artificial sequence
  Synthetic oligonucleotide
ttctctggtgaaagtcagtc

SEQ ID NO: 1088 - DNA, 20 bp, Artificial sequence
  Synthetic oligonucleotide
ctcatctgtcaaagaacagc

SEQ ID NO: 1089 - DNA, 20 bp, Artificial sequence
  Synthetic oligonucleotide
ctcccaagtgagatgtgcta

SEQ ID NO: 1090 - DNA, 20 bp, Artificial sequence
  Synthetic oligonucleotide
cacaccttccaggtcagaca

SEQ ID NO: 1091 - DNA, 20 bp, Artificial sequence
  Synthetic oligonucleotide
ctgcctagcccaaatgcccc

SEQ ID NO: 1092 - DNA, 20 bp, Artificial sequence
  Synthetic oligonucleotide
ttctgcctccaggctctgtc

SEQ ID NO: 1093 - DNA, 20 bp, Artificial sequence
  Synthetic oligonucleotide
ggaggtcctcccagccccat

SEQ ID NO: 1094 - DNA, 20 bp, Artificial sequence
  Synthetic oligonucleotide
ccagaaccttccacactgac

SEQ ID NO: 1095 - DNA, 20 bp, Artificial sequence
  Synthetic oligonucleotide
acttttcccaacaactgtga

SEQ ID NO: 1096 - DNA, 20 bp, Artificial sequence
  Synthetic oligonucleotide
ctggcccttctcccctggca

SEQ ID NO: 1097 - DNA, 20 bp, Artificial sequence
  Synthetic oligonucleotide
caaggctgaaaaagactcag

SEQ ID NO: 1098 - DNA, 20 bp, Artificial sequence
  Synthetic oligonucleotide
agggtgacccaagtccttgg

SEQ ID NO: 1099 - DNA, 20 bp, Artificial sequence
  Synthetic oligonucleotide
caggaaagtctaactccatc

SEQ ID NO: 1100 - DNA, 20 bp, Artificial sequence
  Synthetic oligonucleotide
gcctggttagcctttctgat

SEQ ID NO: 1101 - DNA, 20 bp, Artificial sequence
  Synthetic oligonucleotide
ccctttcctctttcctactt

SEQ ID NO: 1102 - DNA, 20 bp, Artificial sequence
  Synthetic oligonucleotide
tgtaaaataaggatgatggg

SEQ ID NO: 1103 - DNA, 20 bp, Artificial sequence
  Synthetic oligonucleotide
cagagctcaagaagtcccaa

SEQ ID NO: 1104 - DNA, 20 bp, Artificial sequence
  Synthetic oligonucleotide
ggcttcatttcagcccctct

SEQ ID NO: 1105 - DNA, 20 bp, Artificial sequence
  Synthetic oligonucleotide
gcctaggctcttccaaacgg

SEQ ID NO: 1106 - DNA, 20 bp, Artificial sequence
  Synthetic oligonucleotide
ccatcctctcccatgcccgg

SEQ ID NO: 1107 - DNA, 20 bp, Artificial sequence
  Synthetic oligonucleotide
ggcccaaatccctccttacc

SEQ ID NO: 1108 - DNA, 20 bp, Artificial sequence
  Synthetic oligonucleotide
ctctcctccagaattccctg

SEQ ID NO: 1109 - DNA, 20 bp, Artificial sequence
  Synthetic oligonucleotide
taggatcccatctagtggct

SEQ ID NO: 1110 - DNA, 20 bp, Artificial sequence
  Synthetic oligonucleotide
tcccattcccctggtagttt

SEQ ID NO: 1111 - DNA, 20 bp, Artificial sequence
  Synthetic oligonucleotide
ggtggtgagataacactggg

SEQ ID NO: 1112 - DNA, 20 bp, Artificial sequence
  Synthetic oligonucleotide
ggactccttaatgacctgca

SEQ ID NO: 1113 - DNA, 20 bp, Artificial sequence
  Synthetic oligonucleotide
gccaggccccccaccatcat

SEQ ID NO: 1114 - DNA, 20 bp, Artificial sequence
  Synthetic oligonucleotide
tctccttgaagccagcattg

SEQ ID NO: 1115 - DNA, 20 bp, Artificial sequence
  Synthetic oligonucleotide
gattgtccctctcaacctcc

SEQ ID NO: 1116 - DNA, 20 bp, Artificial sequence
  Synthetic oligonucleotide
ataggcagccaggttgttct

SEQ ID NO: 1117 - DNA, 20 bp, Artificial sequence
  Synthetic oligonucleotide
gatctcctcctccagcgact

SEQ ID NO: 1118 - DNA, 20 bp, Artificial sequence
  Synthetic oligonucleotide
ttcggcttcatgcatgttgc

SEQ ID NO: 1119 - DNA, 20 bp, Artificial sequence
  Synthetic oligonucleotide
cctcctgataactggccgcc

SEQ ID NO: 1120 - DNA, 20 bp, Artificial sequence
  Synthetic oligonucleotide
aggctggtttctcgaatctg

SEQ ID NO: 1121 - DNA, 20 bp, Artificial sequence
  Synthetic oligonucleotide
cacggtcttcaccacgatgt

SEQ ID NO: 1122 - DNA, 20 bp, Artificial sequence
  Synthetic oligonucleotide
cctcacatcacatccttgtg

SEQ ID NO: 1123 - DNA, 20 bp, Artificial sequence
  Synthetic oligonucleotide
agcaactatcctgcttctgc

SEQ ID NO: 1124 - DNA, 20 bp, Artificial sequence
  Synthetic oligonucleotide
gctggccatgcccctccaga

SEQ ID NO: 1125 - DNA, 20 bp, Artificial sequence
  Synthetic oligonucleotide
cccccgccctcctccccttc

SEQ ID NO: 1126 - DNA, 20 bp, Artificial sequence
  Synthetic oligonucleotide
aacctccatctctggcaaca

SEQ ID NO: 1127 - DNA, 20 bp, Artificial sequence
  Synthetic oligonucleotide
ctccagcagcctgaggaaac

SEQ ID NO: 1128 - DNA, 20 bp, Artificial sequence
  Synthetic oligonucleotide
gcctctggccagggctacct

SEQ ID NO: 1129 - DNA, 20 bp, Artificial sequence
  Synthetic oligonucleotide
tccccacccatcttagactg

SEQ ID NO: 1130 - DNA, 20 bp, Artificial sequence
  Synthetic oligonucleotide
gctgagaatcaagctcccac

SEQ ID NO: 1131 - DNA, 20 bp, Artificial sequence
  Synthetic oligonucleotide
ccctctatccctcccagcac

SEQ ID NO: 1132 - DNA, 20 bp, Artificial sequence
  Synthetic oligonucleotide
gggcttgacctctctgtacc

SEQ ID NO: 1133 - DNA, 20 bp, Artificial sequence
  Synthetic oligonucleotide
tcacccacaacccctacttg

SEQ ID NO: 1134 - DNA, 20 bp, Artificial sequence
  Synthetic oligonucleotide
ctctcctgtttcagcatctt

SEQ ID NO: 1135 - DNA, 20 bp, Artificial sequence
  Synthetic oligonucleotide
atgccctgcccccatggata

SEQ ID NO: 1136 - DNA, 20 bp, Artificial sequence
  Synthetic oligonucleotide
cccggcctccaggctgcagg

SEQ ID NO: 1137 - DNA, 20 bp, Artificial sequence
  Synthetic oligonucleotide
cacagatcccaccagtctgc

SEQ ID NO: 1138 - DNA, 20 bp, Artificial sequence
  Synthetic oligonucleotide
gaggagaaccctgaagtggg

SEQ ID NO: 1139 - DNA, 20 bp, Artificial sequence
  Synthetic oligonucleotide
agcagcagtgccctgaagat

SEQ ID NO: 1140 - DNA, 20 bp, Artificial sequence
  Synthetic oligonucleotide
cagcatttgtctttattttt

SEQ ID NO: 1141 - DNA, 20 bp, Artificial sequence
  Synthetic oligonucleotide
accttgtgattttccccgtc

SEQ ID NO: 1142 - DNA, 20 bp, Artificial sequence
  Synthetic oligonucleotide
gtacagttactctgtaccac

SEQ ID NO: 1143 - DNA, 20 bp, Artificial sequence
  Synthetic oligonucleotide
ggactcaccacctttaccac

SEQ ID NO: 1144 - DNA, 20 bp, Artificial sequence
  Synthetic oligonucleotide
ggatgaaagaataaagcaga

SEQ ID NO: 1145 - DNA, 20 bp, Artificial sequence
  Synthetic oligonucleotide
ctgtactgacctcgaatctg

SEQ ID NO: 1146 - DNA, 20 bp, Artificial sequence
  Synthetic oligonucleotide
gtctggagcaacctacaggc

SEQ ID NO: 1147 - DNA, 20 bp, Artificial sequence
  Synthetic oligonucleotide
cacgaaggcccccagggaga

SEQ ID NO: 1148 - DNA, 20 bp, Artificial sequence
  Synthetic oligonucleotide
aagctctcacccagttctgc

SEQ ID NO: 1149 - DNA, 20 bp, Artificial sequence
  Synthetic oligonucleotide
tgcttttgccccctgtagtg

SEQ ID NO: 1150 - DNA, 20 bp, Artificial sequence
  Synthetic oligonucleotide
tagtgccccatcaagaggta

SEQ ID NO: 1151 - DNA, 20 bp, Artificial sequence
  Synthetic oligonucleotide
tcacaaagcccagccatgaa

SEQ ID NO: 1152 - DNA, 20 bp, Artificial sequence
  Synthetic oligonucleotide
tccaactcctcctttatatg

SEQ ID NO: 1153 - DNA, 20 bp, Artificial sequence
  Synthetic oligonucleotide
gaatccaatctccctcatgg

SEQ ID NO: 1154 - DNA, 20 bp, Artificial sequence
  Synthetic oligonucleotide
ccagacctgcctgctctttc

SEQ ID NO: 1155 - DNA, 20 bp, Artificial sequence
  Synthetic oligonucleotide
tcctctgatcccaggtaacc

SEQ ID NO: 1156 - DNA, 20 bp, Artificial sequence
  Synthetic oligonucleotide
taactcattactaaggtgcc

SEQ ID NO: 1157 - DNA, 20 bp, Artificial sequence
  Synthetic oligonucleotide
gaccacccccacccaggacc

SEQ ID NO: 1158 - DNA, 20 bp, Artificial sequence
  Synthetic oligonucleotide
aggacacttgaatacctgcc

SEQ ID NO: 1159 - DNA, 20 bp, Artificial sequence
  Synthetic oligonucleotide
gccatcaatcctttcctccc

SEQ ID NO: 1160 - DNA, 20 bp, Artificial sequence
  Synthetic oligonucleotide
aggctccttctccccattcc

SEQ ID NO: 1161 - DNA, 20 bp, Artificial sequence
  Synthetic oligonucleotide
ctgccaatctctgtttctct

SEQ ID NO: 1162 - DNA, 20 bp, Artificial sequence
  Synthetic oligonucleotide
ttccccacgccattgtgtcc

SEQ ID NO: 1163 - DNA, 20 bp, Artificial sequence
  Synthetic oligonucleotide
tccttcccccattctcttgt

SEQ ID NO: 1164 - DNA, 20 bp, Artificial sequence
  Synthetic oligonucleotide
ccatctcacttctctggtga

SEQ ID NO: 1165 - DNA, 20 bp, Artificial sequence
  Synthetic oligonucleotide
cggctctctcatctgtcaaa

SEQ ID NO: 1166 - DNA, 20 bp, Artificial sequence
  Synthetic oligonucleotide
gcaggctcccaagtgagatg

SEQ ID NO: 1167 - DNA, 20 bp, Artificial sequence
  Synthetic oligonucleotide
cgtcaatatcacaccttcca

SEQ ID NO: 1168 - DNA, 20 bp, Artificial sequence
  Synthetic oligonucleotide
cctgcctagcccaaatgccc

SEQ ID NO: 1169 - DNA, 20 bp, Artificial sequence
  Synthetic oligonucleotide
gcttttctgcctccaggctc

SEQ ID NO: 1170 - DNA, 20 bp, Artificial sequence
  Synthetic oligonucleotide
cctttctcccctgcctgcag

SEQ ID NO: 1171 - DNA, 20 bp, Artificial sequence
  Synthetic oligonucleotide
tccagaaccttccacactga

SEQ ID NO: 1172 - DNA, 20 bp, Artificial sequence
  Synthetic oligonucleotide
gacttttcccaacaactgtg

SEQ ID NO: 1173 - DNA, 20 bp, Artificial sequence
  Synthetic oligonucleotide
ccctggcccttctcccctgg

SEQ ID NO: 1174 - DNA, 20 bp, Artificial sequence
  Synthetic oligonucleotide
acaaggctgaaaaagactca

SEQ ID NO: 1175 - DNA, 20 bp, Artificial sequence
  Synthetic oligonucleotide
gagggtgacccaagtccttg

SEQ ID NO: 1176 - DNA, 20 bp, Artificial sequence
  Synthetic oligonucleotide
gccaggaaagtctaactcca

SEQ ID NO: 1177 - DNA, 20 bp, Artificial sequence
  Synthetic oligonucleotide
gtcacattcactaatattta

SEQ ID NO: 1178 - DNA, 20 bp, Artificial sequence
  Synthetic oligonucleotide
cctctactagtcagcctggt

SEQ ID NO: 1179 - DNA, 20 bp, Artificial sequence
  Synthetic oligonucleotide
tcccctttcctctttcctac

SEQ ID NO: 1180 - DNA, 20 bp, Artificial sequence
  Synthetic oligonucleotide
ctctgggcaagttaattgac

SEQ ID NO: 1181 - DNA, 20 bp, Artificial sequence
  Synthetic oligonucleotide
accagagctcaagaagtccc

SEQ ID NO: 1182 - DNA, 20 bp, Artificial sequence
  Synthetic oligonucleotide
tggcttcatttcagcccctc

SEQ ID NO: 1183 - DNA, 20 bp, Artificial sequence
  Synthetic oligonucleotide
cagagagagcctaggctctt

SEQ ID NO: 1184 - DNA, 20 bp, Artificial sequence
  Synthetic oligonucleotide
tgagccatcctctcccatgc

SEQ ID NO: 1185 - DNA, 20 bp, Artificial sequence
  Synthetic oligonucleotide
ctgggcccaaatccctcctt

SEQ ID NO: 1186 - DNA, 20 bp, Artificial sequence
  Synthetic oligonucleotide
tgctctcctccagaattccc

SEQ ID NO: 1187 - DNA, 20 bp, Artificial sequence
  Synthetic oligonucleotide
ctaactttaattctctttct

SEQ ID NO: 1188 - DNA, 20 bp, Artificial sequence
  Synthetic oligonucleotide
ttcccattcccctggtagtt

SEQ ID NO: 1189 - DNA, 20 bp, Artificial sequence
  Synthetic oligonucleotide
gggtggtgagataacactgg

SEQ ID NO: 1190 - DNA, 20 bp, Artificial sequence
  Synthetic oligonucleotide
tggactccttaatgacctgc

SEQ ID NO: 1191 - DNA, 20 bp, Artificial sequence
  Synthetic oligonucleotide
gagccaggccccccaccatc

SEQ ID NO: 1192 - DNA, 20 bp, Artificial sequence
  Synthetic oligonucleotide
cgggtctccttgaagccagc

SEQ ID NO: 1193 - DNA, 20 bp, Artificial sequence
  Synthetic oligonucleotide
ccagattgtccctctcaacc

SEQ ID NO: 1194 - DNA, 20 bp, Artificial sequence
  Synthetic oligonucleotide
gcttcctgtctataggcagc

SEQ ID NO: 1195 - DNA, 20 bp, Artificial sequence
  Synthetic oligonucleotide
ggatctcctcctccagcgac

SEQ ID NO: 1196 - DNA, 20 bp, Artificial sequence
  Synthetic oligonucleotide
tcttcggcttcatgcatgtt

SEQ ID NO: 1197 - DNA, 20 bp, Artificial sequence
  Synthetic oligonucleotide
cgcctcctgataactggccg

SEQ ID NO: 1198 - DNA, 20 bp, Artificial sequence
  Synthetic oligonucleotide
agacttggtgtccaggctgg

SEQ ID NO: 1199 - DNA, 20 bp, Artificial sequence
  Synthetic oligonucleotide
ctccacggtcttcaccacga

SEQ ID NO: 1200 - DNA, 20 bp, Artificial sequence
  Synthetic oligonucleotide
gcctcacatcacatccttgt

SEQ ID NO: 1201 - DNA, 20 bp, Artificial sequence
  Synthetic oligonucleotide
gagcaactatcctgcttctg

SEQ ID NO: 1202 - DNA, 20 bp, Artificial sequence
  Synthetic oligonucleotide
gctgctggccatgcccctcc

SEQ ID NO: 1203 - DNA, 20 bp, Artificial sequence
  Synthetic oligonucleotide
gccccccgccctcctcccct

SEQ ID NO: 1204 - DNA, 20 bp, Artificial sequence
  Synthetic oligonucleotide
gagaacctccatctctggca

SEQ ID NO: 1205 - DNA, 20 bp, Artificial sequence
  Synthetic oligonucleotide
cagttttcctccagcagcct

SEQ ID NO: 1206 - DNA, 20 bp, Artificial sequence
  Synthetic oligonucleotide
acaaaacaagcctctggcca

SEQ ID NO: 1207 - DNA, 20 bp, Artificial sequence
  Synthetic oligonucleotide
gtccccacccatcttagact

SEQ ID NO: 1208 - DNA, 20 bp, Artificial sequence
  Synthetic oligonucleotide
tgctgagaatcaagctccca

SEQ ID NO: 1209 - DNA, 20 bp, Artificial sequence
  Synthetic oligonucleotide
cccctctatccctcccagca

SEQ ID NO: 1210 - DNA, 20 bp, Artificial sequence
  Synthetic oligonucleotide
tgggcttgacctctctgtac

SEQ ID NO: 1211 - DNA, 20 bp, Artificial sequence
  Synthetic oligonucleotide
gtcacccacaacccctactt

SEQ ID NO: 1212 - DNA, 20 bp, Artificial sequence
  Synthetic oligonucleotide
cctttctctcctgtttcagc

SEQ ID NO: 1213 - DNA, 20 bp, Artificial sequence
  Synthetic oligonucleotide
catgccctgcccccatggat

SEQ ID NO: 1214 - DNA, 20 bp, Artificial sequence
  Synthetic oligonucleotide
cacccggcctccaggctgca

SEQ ID NO: 1215 - DNA, 20 bp, Artificial sequence
  Synthetic oligonucleotide
gcacagatcccaccagtctg

SEQ ID NO: 1216 - DNA, 20 bp, Artificial sequence
  Synthetic oligonucleotide
agaggagaaccctgaagtgg

SEQ ID NO: 1217 - DNA, 20 bp, Artificial sequence
  Synthetic oligonucleotide
ctcagcgactaaaggcagca

SEQ ID NO: 1218 - DNA, 20 bp, Artificial sequence
  Synthetic oligonucleotide
gcagcatttgtctttatttt

SEQ ID NO: 1219 - DNA, 20 bp, Artificial sequence
  Synthetic oligonucleotide
tgaccttgtgattttccccg

SEQ ID NO: 1220 - DNA, 20 bp, Artificial sequence
  Synthetic oligonucleotide
tgtacagttactctgtacca

SEQ ID NO: 1221 - DNA, 20 bp, Artificial sequence
  Synthetic oligonucleotide
aggactcaccacctttacca

SEQ ID NO: 1222 - DNA, 20 bp, Artificial sequence
  Synthetic oligonucleotide
gggatgaaagaataaagcag

SEQ ID NO: 1223 - DNA, 20 bp, Artificial sequence
  Synthetic oligonucleotide
gctgtactgacctcgaatct

SEQ ID NO: 1224 - DNA, 20 bp, Artificial sequence
  Synthetic oligonucleotide
ctcagtcccagtctggagca

SEQ ID NO: 1225 - DNA, 20 bp, Artificial sequence
  Synthetic oligonucleotide
gcagtgtcacgaaggccccc

SEQ ID NO: 1226 - DNA, 20 bp, Artificial sequence
  Synthetic oligonucleotide
tcaagctctcacccagttct

SEQ ID NO: 1227 - DNA, 20 bp, Artificial sequence
  Synthetic oligonucleotide
ggtgcttttgccccctgtag

SEQ ID NO: 1228 - DNA, 20 bp, Artificial sequence
  Synthetic oligonucleotide
atagtgccccatcaagaggt

SEQ ID NO: 1229 - DNA, 20 bp, Artificial sequence
  Synthetic oligonucleotide
gtcacaaagcccagccatga

SEQ ID NO: 1230 - DNA, 20 bp, Artificial sequence
  Synthetic oligonucleotide
cttccaactcctcctttata

SEQ ID NO: 1231 - DNA, 20 bp, Artificial sequence
  Synthetic oligonucleotide
agaatccaatctccctcatg

SEQ ID NO: 1232 - DNA, 20 bp, Artificial sequence
  Synthetic oligonucleotide
cgcccagacctgcctgctct

SEQ ID NO: 1233 - DNA, 20 bp, Artificial sequence
  Synthetic oligonucleotide
ttcctctgatcccaggtaac

SEQ ID NO: 1234 - DNA, 20 bp, Artificial sequence
  Synthetic oligonucleotide
ttaactcattactaaggtgc

SEQ ID NO: 1235 - DNA, 20 bp, Artificial sequence
  Synthetic oligonucleotide
agaccacccccacccaggac

SEQ ID NO: 1236 - DNA, 20 bp, Artificial sequence
  Synthetic oligonucleotide
ccaggctcttctgaggacac

SEQ ID NO: 1237 - DNA, 20 bp, Artificial sequence
  Synthetic oligonucleotide
ggccatcaatcctttcctcc

SEQ ID NO: 1238 - DNA, 20 bp, Artificial sequence
  Synthetic oligonucleotide
ccaggctccttctccccatt

SEQ ID NO: 1239 - DNA, 20 bp, Artificial sequence
  Synthetic oligonucleotide
ctctacctgccaatctctgt

SEQ ID NO: 1240 - DNA, 20 bp, Artificial sequence
  Synthetic oligonucleotide
gttccccacgccattgtgtc

SEQ ID NO: 1241 - DNA, 20 bp, Artificial sequence
  Synthetic oligonucleotide
ctccttcccccattctcttg

SEQ ID NO: 1242 - DNA, 20 bp, Artificial sequence
  Synthetic oligonucleotide
gctactactaataatagcaa

SEQ ID NO: 1243 - DNA, 20 bp, Artificial sequence
  Synthetic oligonucleotide
ttcggctctctcatctgtca

SEQ ID NO: 1244 - DNA, 20 bp, Artificial sequence
  Synthetic oligonucleotide
atgcaggctcccaagtgaga

SEQ ID NO: 1245 - DNA, 20 bp, Artificial sequence
  Synthetic oligonucleotide
ccacactacatataagctct

SEQ ID NO: 1246 - DNA, 20 bp, Artificial sequence
  Synthetic oligonucleotide
tcctgcctagcccaaatgcc

SEQ ID NO: 1247 - DNA, 20 bp, Artificial sequence
  Synthetic oligonucleotide
tgtgcttttctgcctccagg

SEQ ID NO: 1248 - DNA, 20 bp, Artificial sequence
  Synthetic oligonucleotide
tagccctttctcccctgcct

SEQ ID NO: 1249 - DNA, 20 bp, Artificial sequence
  Synthetic oligonucleotide
atccagaaccttccacactg

SEQ ID NO: 1250 - DNA, 20 bp, Artificial sequence
  Synthetic oligonucleotide
gggacttttcccaacaactg

SEQ ID NO: 1251 - DNA, 20 bp, Artificial sequence
  Synthetic oligonucleotide
cgtccctggcccttctcccc

SEQ ID NO: 1252 - DNA, 20 bp, Artificial sequence
  Synthetic oligonucleotide
cacaaggctgaaaaagactc

SEQ ID NO: 1253 - DNA, 20 bp, Artificial sequence
  Synthetic oligonucleotide
ggagggtgacccaagtcctt

SEQ ID NO: 1254 - DNA, 20 bp, Artificial sequence
  Synthetic oligonucleotide
tgccaggaaagtctaactcc

SEQ ID NO: 1255 - DNA, 20 bp, Artificial sequence
  Synthetic oligonucleotide
tccccccgccccgcccgaga

SEQ ID NO: 1256 - DNA, 20 bp, Artificial sequence
  Synthetic oligonucleotide
ctgtcccctttcctctttcc

SEQ ID NO: 1257 - DNA, 20 bp, Artificial sequence
  Synthetic oligonucleotide
ccaaccagccacatgactct

SEQ ID NO: 1258 - DNA, 20 bp, Artificial sequence
  Synthetic oligonucleotide
tcaggagaccagagctcaag

SEQ ID NO: 1259 - DNA, 20 bp, Artificial sequence
  Synthetic oligonucleotide
cctggcttcatttcagcccc

SEQ ID NO: 1260 - DNA, 20 bp, Artificial sequence
  Synthetic oligonucleotide
gcagagagagcctaggctct

SEQ ID NO: 1261 - DNA, 20 bp, Artificial sequence
  Synthetic oligonucleotide
ggcatgagccatcctctccc

SEQ ID NO: 1262 - DNA, 20 bp, Artificial sequence
  Synthetic oligonucleotide
actgggcccaaatccctcct

SEQ ID NO: 1263 - DNA, 20 bp, Artificial sequence
  Synthetic oligonucleotide
ttgctctcctccagaattcc

SEQ ID NO: 1264 - DNA, 20 bp, Artificial sequence
  Synthetic oligonucleotide
ctactaactttaattctctt

SEQ ID NO: 1265 - DNA, 20 bp, Artificial sequence
  Synthetic oligonucleotide
cttcccattcccctggtagt

SEQ ID NO: 1266 - DNA, 20 bp, Artificial sequence
  Synthetic oligonucleotide
gtcttacttttcttgatagt

SEQ ID NO: 1267 - DNA, 20 bp, Artificial sequence
  Synthetic oligonucleotide
ttggactccttaatgacctg

SEQ ID NO: 1268 - DNA, 20 bp, Artificial sequence
  Synthetic oligonucleotide
tccataacaacaggaatcag

SEQ ID NO: 1269 - DNA, 20 bp, Artificial sequence
  Synthetic oligonucleotide
tggcaacagtttccataaca

SEQ ID NO: 1270 - DNA, 20 bp, Artificial sequence
  Synthetic oligonucleotide
ctccatctctggcaacagtt

SEQ ID NO: 1271 - DNA, 20 bp, Artificial sequence
  Synthetic oligonucleotide
agttcccagatactccgaga

SEQ ID NO: 1272 - DNA, 20 bp, Artificial sequence
  Synthetic oligonucleotide
ctcaaaggcacagttcccag

SEQ ID NO: 1273 - DNA, 20 bp, Artificial sequence
  Synthetic oligonucleotide
tttcctccagcagcctgagg

SEQ ID NO: 1274 - DNA, 20 bp, Artificial sequence
  Synthetic oligonucleotide
gagtctcagttttcctccag

SEQ ID NO: 1275 - DNA, 20 bp, Artificial sequence
  Synthetic oligonucleotide
gaatcaagctcccacctgcc

SEQ ID NO: 1276 - DNA, 20 bp, Artificial sequence
  Synthetic oligonucleotide
ctgagaatcaagctcccacc

SEQ ID NO: 1277 - DNA, 20 bp, Artificial sequence
  Synthetic oligonucleotide
ttttcctcagcgactaaagg

SEQ ID NO: 1278 - DNA, 20 bp, Artificial sequence
  Synthetic oligonucleotide
ggcgcagcatttgtctttat

SEQ ID NO: 1279 - DNA, 20 bp, Artificial sequence
  Synthetic oligonucleotide
atatcttgtgaccttgtgat

SEQ ID NO: 1280 - DNA, 20 bp, Artificial sequence
  Synthetic oligonucleotide
tttgagatatcttgtgacct

SEQ ID NO: 1281 - DNA, 20 bp, Artificial sequence
  Synthetic oligonucleotide
gaggcttttgagatatcttg

SEQ ID NO: 1282 - DNA, 20 bp, Artificial sequence
  Synthetic oligonucleotide
attgtgaggcttttgagata

SEQ ID NO: 1283 - DNA, 20 bp, Artificial sequence
  Synthetic oligonucleotide
gacccaagtccttggccttg

SEQ ID NO: 1284 - DNA, 20 bp, Artificial sequence
  Synthetic oligonucleotide
tttggagggtgacccaagtc

SEQ ID NO: 1285 - DNA, 20 bp, Artificial sequence
  Synthetic oligonucleotide
ctcttagtttggagggtgac

SEQ ID NO: 1286 - DNA, 20 bp, Artificial sequence
  Synthetic oligonucleotide
ccttttaccaagctggaaat

SEQ ID NO: 1287 - DNA, 20 bp, Artificial sequence
  Synthetic oligonucleotide
gtagtttccttttaccaagc

SEQ ID NO: 1288 - DNA, 20 bp, Artificial sequence
  Synthetic oligonucleotide
gagacttctcgggcactcct

SEQ ID NO: 1289 - DNA, 20 bp, Artificial sequence
  Synthetic oligonucleotide
tgggcctgtttctggtccct

SEQ ID NO: 1290 - DNA, 20 bp, Artificial sequence
  Synthetic oligonucleotide
ttccccagtagggaggtgct

SEQ ID NO: 1291 - DNA, 20 bp, Artificial sequence
  Synthetic oligonucleotide
ataggtgagctcgctgccca

SEQ ID NO: 1292 - DNA, 20 bp, Artificial sequence
  Synthetic oligonucleotide
cacaggctcagaataggtga

SEQ ID NO: 1293 - DNA, 20 bp, Artificial sequence
  Synthetic oligonucleotide
caagtcaaagtaacttgatg

SEQ ID NO: 1294 - DNA, 20 bp, Artificial sequence
  Synthetic oligonucleotide
tgaattttattatgaccacc

SEQ ID NO: 1295 - DNA, 20 bp, Artificial sequence
  Synthetic oligonucleotide
catgtcctgtcagctcagtg

SEQ ID NO: 1296 - DNA, 20 bp, Artificial sequence
  Synthetic oligonucleotide
cacaagcatacactcactgt

SEQ ID NO: 1297 - DNA, 20 bp, Artificial sequence
  Synthetic oligonucleotide
cagggttggtgcacctgctt

SEQ ID NO: 1298 - DNA, 20 bp, Artificial sequence
  Synthetic oligonucleotide
tagacagaggacttgtctgg

SEQ ID NO: 1299 - DNA, 20 bp, Artificial sequence
  Synthetic oligonucleotide
cccttgaggcagctgtcaca

SEQ ID NO: 1300 - DNA, 20 bp, Artificial sequence
  Synthetic oligonucleotide
cattgctctggcgggctgag

SEQ ID NO: 1301 - DNA, 20 bp, Artificial sequence
  Synthetic oligonucleotide
caatctctgtgttgagcttt

SEQ ID NO: 1302 - DNA, 20 bp, Artificial sequence
  Synthetic oligonucleotide
tcatttcctgtctctacctg

SEQ ID NO: 1303 - DNA, 20 bp, Artificial sequence
  Synthetic oligonucleotide
gaccagggtgagagaagcgg

SEQ ID NO: 1304 - DNA, 20 bp, Artificial sequence
  Synthetic oligonucleotide
gaggaggcaggctggcccac

SEQ ID NO: 1305 - DNA, 20 bp, Artificial sequence
  Synthetic oligonucleotide
aataatgggtacttttgaaa

SEQ ID NO: 1306 - DNA, 20 bp, Artificial sequence
  Synthetic oligonucleotide
ttcatagtaaggtaatccat

SEQ ID NO: 1307 - DNA, 20 bp, Artificial sequence
  Synthetic oligonucleotide
cctctctggacttcggctct

SEQ ID NO: 1308 - DNA, 20 bp, Artificial sequence
  Synthetic oligonucleotide
ggcactatgtttgggtgcac

SEQ ID NO: 1309 - DNA, 20 bp, Artificial sequence
  Synthetic oligonucleotide
tctacagtgtctttcctggc

SEQ ID NO: 1310 - DNA, 20 bp, Artificial sequence
  Synthetic oligonucleotide
ctaggtgccctggctaggct

SEQ ID NO: 1311 - DNA, 20 bp, Artificial sequence
  Synthetic oligonucleotide
tgcagggaggtcctcccagc

SEQ ID NO: 1312 - DNA, 20 bp, Artificial sequence
  Synthetic oligonucleotide
gcgagcggaggcctgggtgt

SEQ ID NO: 1313 - DNA, 20 bp, Artificial sequence
  Synthetic oligonucleotide
actgacagctgcatctgcgg

SEQ ID NO: 1314 - DNA, 20 bp, Artificial sequence
  Synthetic oligonucleotide
aagcgaatgaatgaacagtg

SEQ ID NO: 1315 - DNA, 20 bp, Artificial sequence
  Synthetic oligonucleotide
cctggctgggacttttccca

SEQ ID NO: 1316 - DNA, 20 bp, Artificial sequence
  Synthetic oligonucleotide
gggaggtgagcagcacccca

SEQ ID NO: 1317 - DNA, 20 bp, Artificial sequence
  Synthetic oligonucleotide
tggccgtccctgctccgccc

SEQ ID NO: 1318 - DNA, 20 bp, Artificial sequence
  Synthetic oligonucleotide
ggccggtcccgcggagcccc

SEQ ID NO: 1319 - DNA, 20 bp, Artificial sequence
  Synthetic oligonucleotide
gggatggagccggccggtcc

SEQ ID NO: 1320 - DNA, 20 bp, Artificial sequence
  Synthetic oligonucleotide
agcagggagacttccccagg

SEQ ID NO: 1321 - DNA, 20 bp, Artificial sequence
  Synthetic oligonucleotide
actcagtccctgaagggagc

SEQ ID NO: 1322 - DNA, 20 bp, Artificial sequence
  Synthetic oligonucleotide
ctgctatgtgtgaggcaggc

SEQ ID NO: 1323 - DNA, 20 bp, Artificial sequence
  Synthetic oligonucleotide
caatcttggctgggaagatg

SEQ ID NO: 1324 - DNA, 20 bp, Artificial sequence
  Synthetic oligonucleotide
agatgggtgaggtgaggagt

SEQ ID NO: 1325 - DNA, 20 bp, Artificial sequence
  Synthetic oligonucleotide
ccttttccttgccaggaaag

SEQ ID NO: 1326 - DNA, 20 bp, Artificial sequence
  Synthetic oligonucleotide
agtaatttagctcccccctc

SEQ ID NO: 1327 - DNA, 20 bp, Artificial sequence
  Synthetic oligonucleotide
agaatcatttcagggccaat

SEQ ID NO: 1328 - DNA, 20 bp, Artificial sequence
  Synthetic oligonucleotide
gaagaagaggaattttgttc

SEQ ID NO: 1329 - DNA, 20 bp, Artificial sequence
  Synthetic oligonucleotide
ttaagtcctgagacatgcat

SEQ ID NO: 1330 - DNA, 20 bp, Artificial sequence
  Synthetic oligonucleotide
tttctgatgctgaattaagt

SEQ ID NO: 1331 - DNA, 20 bp, Artificial sequence
  Synthetic oligonucleotide
taggatttggcagtattacc

SEQ ID NO: 1332 - DNA, 20 bp, Artificial sequence
  Synthetic oligonucleotide
tgtggcacatattagtgctc

SEQ ID NO: 1333 - DNA, 20 bp, Artificial sequence
  Synthetic oligonucleotide
aatccccttactcgggagtc

SEQ ID NO: 1334 - DNA, 20 bp, Artificial sequence
  Synthetic oligonucleotide
ttgaaatcaggagaccagga

SEQ ID NO: 1335 - DNA, 20 bp, Artificial sequence
  Synthetic oligonucleotide
aaaacccagcacggtattga

SEQ ID NO: 1336 - DNA, 20 bp, Artificial sequence
  Synthetic oligonucleotide
ccgagcagagagagcctagg

SEQ ID NO: 1337 - DNA, 20 bp, Artificial sequence
  Synthetic oligonucleotide
catggactttcagggcatga

SEQ ID NO: 1338 - DNA, 20 bp, Artificial sequence
  Synthetic oligonucleotide
cagcctatggagggactgag

SEQ ID NO: 1339 - DNA, 20 bp, Artificial sequence
  Synthetic oligonucleotide
aagagagagtgtgtattagg

SEQ ID NO: 1340 - DNA, 20 bp, Artificial sequence
  Synthetic oligonucleotide
tttctctccctggcaagcaa

SEQ ID NO: 1341 - DNA, 20 bp, Artificial sequence
  Synthetic oligonucleotide
aactgtgtctgctagagttg

SEQ ID NO: 1342 - DNA, 20 bp, Artificial sequence
  Synthetic oligonucleotide
gtaagctgctggagtaagat

SEQ ID NO: 1343 - DNA, 20 bp, Artificial sequence
  Synthetic oligonucleotide
atagtaaccacagctgcctt

SEQ ID NO: 1344 - DNA, 20 bp, Artificial sequence
  Synthetic oligonucleotide
gtaaccttgggaagtccccg

SEQ ID NO: 1345 - DNA, 20 bp, Artificial sequence
  Synthetic oligonucleotide
gtttccataacaacaggaat

SEQ ID NO: 1346 - DNA, 20 bp, Artificial sequence
  Synthetic oligonucleotide
ctggcaacagtttccataac

SEQ ID NO: 1347 - DNA, 20 bp, Artificial sequence
  Synthetic oligonucleotide
cagatactccgagagaacct

SEQ ID NO: 1348 - DNA, 20 bp, Artificial sequence
  Synthetic oligonucleotide
cagttcccagatactccgag

SEQ ID NO: 1349 - DNA, 20 bp, Artificial sequence
  Synthetic oligonucleotide
aaactcaaaggcacagttcc

SEQ ID NO: 1350 - DNA, 20 bp, Artificial sequence
  Synthetic oligonucleotide
ttttcctccagcagcctgag

SEQ ID NO: 1351 - DNA, 20 bp, Artificial sequence
  Synthetic oligonucleotide
tgagtctcagttttcctcca

SEQ ID NO: 1352 - DNA, 20 bp, Artificial sequence
  Synthetic oligonucleotide
agaatcaagctcccacctgc

SEQ ID NO: 1353 - DNA, 20 bp, Artificial sequence
  Synthetic oligonucleotide
tcctcagcgactaaaggcag

SEQ ID NO: 1354 - DNA, 20 bp, Artificial sequence
  Synthetic oligonucleotide
atttttcctcagcgactaaa

SEQ ID NO: 1355 - DNA, 20 bp, Artificial sequence
  Synthetic oligonucleotide
agggcgcagcatttgtcttt

SEQ ID NO: 1356 - DNA, 20 bp, Artificial sequence
  Synthetic oligonucleotide
gagatatcttgtgaccttgt

SEQ ID NO: 1357 - DNA, 20 bp, Artificial sequence
  Synthetic oligonucleotide
ttttgagatatcttgtgacc

SEQ ID NO: 1358 - DNA, 20 bp, Artificial sequence
  Synthetic oligonucleotide
tgaggcttttgagatatctt

SEQ ID NO: 1359 - DNA, 20 bp, Artificial sequence
  Synthetic oligonucleotide
tattgtgaggcttttgagat

SEQ ID NO: 1360 - DNA, 20 bp, Artificial sequence
  Synthetic oligonucleotide
ggtgacccaagtccttggcc

SEQ ID NO: 1361 - DNA, 20 bp, Artificial sequence
  Synthetic oligonucleotide
gtttggagggtgacccaagt

SEQ ID NO: 1362 - DNA, 20 bp, Artificial sequence
  Synthetic oligonucleotide
accaagctggaaatggaaag

SEQ ID NO: 1363 - DNA, 20 bp, Artificial sequence
  Synthetic oligonucleotide
tccttttaccaagctggaaa

SEQ ID NO: 1364 - DNA, 20 bp, Artificial sequence
  Synthetic oligonucleotide
ggtagtttccttttaccaag

SEQ ID NO: 1365 - DNA, 20 bp, Artificial sequence
  Synthetic oligonucleotide
ctgagacttctcgggcactc

SEQ ID NO: 1366 - DNA, 20 bp, Artificial sequence
  Synthetic oligonucleotide
ggcatgcgggcatcagatcc

SEQ ID NO: 1367 - DNA, 20 bp, Artificial sequence
  Synthetic oligonucleotide
ctcctgcactgctttcccca

SEQ ID NO: 1368 - DNA, 20 bp, Artificial sequence
  Synthetic oligonucleotide
gaataggtgagctcgctgcc

SEQ ID NO: 1369 - DNA, 20 bp, Artificial sequence
  Synthetic oligonucleotide
atatggacacaggctcagaa

SEQ ID NO: 1370 - DNA, 20 bp, Artificial sequence
  Synthetic oligonucleotide
ctgtgcaagtcaaagtaact

SEQ ID NO: 1371 - DNA, 20 bp, Artificial sequence
  Synthetic oligonucleotide
atgaattttattatgaccac

SEQ ID NO: 1372 - DNA, 20 bp, Artificial sequence
  Synthetic oligonucleotide
acttgaaggcacacatgcat

SEQ ID NO: 1373 - DNA, 20 bp, Artificial sequence
  Synthetic oligonucleotide
caggcgcatccacaagcata

SEQ ID NO: 1374 - DNA, 20 bp, Artificial sequence
  Synthetic oligonucleotide
ctggaggatgagcagatgtg

SEQ ID NO: 1375 - DNA, 20 bp, Artificial sequence
  Synthetic oligonucleotide
agcagcaggaggattaaggg

SEQ ID NO: 1376 - DNA, 20 bp, Artificial sequence
  Synthetic oligonucleotide
tcccttgaggcagctgtcac

SEQ ID NO: 1377 - DNA, 20 bp, Artificial sequence
  Synthetic oligonucleotide
ggagcagcacattgctctgg

SEQ ID NO: 1378 - DNA, 20 bp, Artificial sequence
  Synthetic oligonucleotide
ttgcaatctctgtgttgagc

SEQ ID NO: 1379 - DNA, 20 bp, Artificial sequence
  Synthetic oligonucleotide
agttcgaatgctctcttgtc

SEQ ID NO: 1380 - DNA, 20 bp, Artificial sequence
  Synthetic oligonucleotide
accttggagcggtaccactc

SEQ ID NO: 1381 - DNA, 20 bp, Artificial sequence
  Synthetic oligonucleotide
tcagtcacctggagaggata

SEQ ID NO: 1382 - DNA, 20 bp, Artificial sequence
  Synthetic oligonucleotide
agcaatagtagcagtaataa

SEQ ID NO: 1383 - DNA, 20 bp, Artificial sequence
  Synthetic oligonucleotide
cttcatagtaaggtaatcca

SEQ ID NO: 1384 - DNA, 20 bp, Artificial sequence
  Synthetic oligonucleotide
atggaatgcaggctcccaag

SEQ ID NO: 1385 - DNA, 20 bp, Artificial sequence
  Synthetic oligonucleotide
tgttctctacgggcactatg

SEQ ID NO: 1386 - DNA, 20 bp, Artificial sequence
  Synthetic oligonucleotide
ccactaggaatggccctccc

SEQ ID NO: 1387 - DNA, 20 bp, Artificial sequence
  Synthetic oligonucleotide
ctcagctaggtgccctggct

SEQ ID NO: 1388 - DNA, 20 bp, Artificial sequence
  Synthetic oligonucleotide
cctcaccctgggttctaata

SEQ ID NO: 1389 - DNA, 20 bp, Artificial sequence
  Synthetic oligonucleotide
aggcgagcggaggcctgggt

SEQ ID NO: 1390 - DNA, 20 bp, Artificial sequence
  Synthetic oligonucleotide
acactgacagctgcatctgc

SEQ ID NO: 1391 - DNA, 20 bp, Artificial sequence
  Synthetic oligonucleotide
cacctggtcagcaagcgaat

SEQ ID NO: 1392 - DNA, 20 bp, Artificial sequence
  Synthetic oligonucleotide
ggccctggctgggacttttc

SEQ ID NO: 1393 - DNA, 20 bp, Artificial sequence
  Synthetic oligonucleotide
aaatcagggaggtgagcagc

SEQ ID NO: 1394 - DNA, 20 bp, Artificial sequence
  Synthetic oligonucleotide
cttctcccctggcatctcct

SEQ ID NO: 1395 - DNA, 20 bp, Artificial sequence
  Synthetic oligonucleotide
tggagccggccggtcccgcg

SEQ ID NO: 1396 - DNA, 20 bp, Artificial sequence
  Synthetic oligonucleotide
tgagggctcaccggttctcc

SEQ ID NO: 1397 - DNA, 20 bp, Artificial sequence
  Synthetic oligonucleotide
aggcagcagggagacttccc

SEQ ID NO: 1398 - DNA, 20 bp, Artificial sequence
  Synthetic oligonucleotide
aagggatctgcacacaaggc

SEQ ID NO: 1399 - DNA, 20 bp, Artificial sequence
  Synthetic oligonucleotide
tcagtcatcaaacatctagt

SEQ ID NO: 1400 - DNA, 20 bp, Artificial sequence
  Synthetic oligonucleotide
ccaatcttggctgggaagat

SEQ ID NO: 1401 - DNA, 20 bp, Artificial sequence
  Synthetic oligonucleotide
aagagatgggtgaggtgagg

SEQ ID NO: 1402 - DNA, 20 bp, Artificial sequence
  Synthetic oligonucleotide
taggctgggtcttggtgcgg

SEQ ID NO: 1403 - DNA, 20 bp, Artificial sequence
  Synthetic oligonucleotide
aagtaatttagctcccccct

SEQ ID NO: 1404 - DNA, 20 bp, Artificial sequence
  Synthetic oligonucleotide
aagaatcatttcagggccaa

SEQ ID NO: 1405 - DNA, 20 bp, Artificial sequence
  Synthetic oligonucleotide
cagaagaagaggaattttgt

SEQ ID NO: 1406 - DNA, 20 bp, Artificial sequence
  Synthetic oligonucleotide
attaagtcctgagacatgca

SEQ ID NO: 1407 - DNA, 20 bp, Artificial sequence
  Synthetic oligonucleotide
cctttctgatgctgaattaa

SEQ ID NO: 1408 - DNA, 20 bp, Artificial sequence
  Synthetic oligonucleotide
gtgactatctaggatttggc

SEQ ID NO: 1409 - DNA, 20 bp, Artificial sequence
  Synthetic oligonucleotide
gaggagacaattaactaaaa

SEQ ID NO: 1410 - DNA, 20 bp, Artificial sequence
  Synthetic oligonucleotide
tcgaaagcaggcaagcaagc

SEQ ID NO: 1411 - DNA, 20 bp, Artificial sequence
  Synthetic oligonucleotide
attgaaatcaggagaccagg

SEQ ID NO: 1412 - DNA, 20 bp, Artificial sequence
  Synthetic oligonucleotide
catttcagcccctctgcaag

SEQ ID NO: 1413 - DNA, 20 bp, Artificial sequence
  Synthetic oligonucleotide
cctatgcaaccgagcagaga

SEQ ID NO: 1414 - DNA, 20 bp, Artificial sequence
  Synthetic oligonucleotide
gtgtccaggctggtttctgc

SEQ ID NO: 1415 - DNA, 20 bp, Artificial sequence
  Synthetic oligonucleotide
accaaggctccccttagaac

SEQ ID NO: 1416 - DNA, 20 bp, Artificial sequence
  Synthetic oligonucleotide
aaagagagagtgtgtattag

SEQ ID NO: 1417 - DNA, 20 bp, Artificial sequence
  Synthetic oligonucleotide
tctttctctccctggcaagc

SEQ ID NO: 1418 - DNA, 20 bp, Artificial sequence
  Synthetic oligonucleotide
tggaaatggaaagccctccc

SEQ ID NO: 1419 - DNA, 20 bp, Artificial sequence
  Synthetic oligonucleotide
gagtggtaagctgctggagt

SEQ ID NO: 1420 - DNA, 20 bp, Artificial sequence
  Synthetic oligonucleotide
tgatagtaaccacagctgcc

SEQ ID NO: 1421 - DNA, 20 bp, Artificial sequence
  Synthetic oligonucleotide
gtgtaaccttgggaagtccc

SEQ ID NO: 1422 - DNA, 20 bp, Artificial sequence
  Synthetic oligonucleotide
cagtttccataacaacagga

SEQ ID NO: 1423 - DNA, 20 bp, Artificial sequence
  Synthetic oligonucleotide
ctctggcaacagtttccata

SEQ ID NO: 1424 - DNA, 20 bp, Artificial sequence
  Synthetic oligonucleotide
tcccagatactccgagagaa

SEQ ID NO: 1425 - DNA, 20 bp, Artificial sequence
  Synthetic oligonucleotide
aggcacagttcccagatact

SEQ ID NO: 1426 - DNA, 20 bp, Artificial sequence
  Synthetic oligonucleotide
tcctccagcagcctgaggaa

SEQ ID NO: 1427 - DNA, 20 bp, Artificial sequence
  Synthetic oligonucleotide
gttttcctccagcagcctga

SEQ ID NO: 1428 - DNA, 20 bp, Artificial sequence
  Synthetic oligonucleotide
aagctcccacctgcccacag

SEQ ID NO: 1429 - DNA, 20 bp, Artificial sequence
  Synthetic oligonucleotide
gagaatcaagctcccacctg

SEQ ID NO: 1430 - DNA, 20 bp, Artificial sequence
  Synthetic oligonucleotide
ttcctcagcgactaaaggca

SEQ ID NO: 1431 - DNA, 20 bp, Artificial sequence
  Synthetic oligonucleotide
tatttttcctcagcgactaa

SEQ ID NO: 1432 - DNA, 20 bp, Artificial sequence
  Synthetic oligonucleotide
gaagggcgcagcatttgtct

SEQ ID NO: 1433 - DNA, 20 bp, Artificial sequence
  Synthetic oligonucleotide
tgagatatcttgtgaccttg

SEQ ID NO: 1434 - DNA, 20 bp, Artificial sequence
  Synthetic oligonucleotide
cttttgagatatcttgtgac

SEQ ID NO: 1435 - DNA, 20 bp, Artificial sequence
  Synthetic oligonucleotide
tgtgaggcttttgagatatc

SEQ ID NO: 1436 - DNA, 20 bp, Artificial sequence
  Synthetic oligonucleotide
cgtattgtgaggcttttgag

SEQ ID NO: 1437 - DNA, 20 bp, Artificial sequence
  Synthetic oligonucleotide
gggtgacccaagtccttggc

SEQ ID NO: 1438 - DNA, 20 bp, Artificial sequence
  Synthetic oligonucleotide
agtttggagggtgacccaag

SEQ ID NO: 1439 - DNA, 20 bp, Artificial sequence
  Synthetic oligonucleotide
tttaccaagctggaaatgga

SEQ ID NO: 1440 - DNA, 20 bp, Artificial sequence
  Synthetic oligonucleotide
ttccttttaccaagctggaa

SEQ ID NO: 1441 - DNA, 20 bp, Artificial sequence
  Synthetic oligonucleotide
tcccctggtagtttcctttt

SEQ ID NO: 1442 - DNA, 20 bp, Artificial sequence
  Synthetic oligonucleotide
cagggaggttcggcccctcc

SEQ ID NO: 1443 - DNA, 20 bp, Artificial sequence
  Synthetic oligonucleotide
ctcctggcagaaggcatgcg

SEQ ID NO: 1444 - DNA, 20 bp, Artificial sequence
  Synthetic oligonucleotide
ggccccgctgctcctgcact

SEQ ID NO: 1445 - DNA, 20 bp, Artificial sequence
  Synthetic oligonucleotide
cagaataggtgagctcgctg

SEQ ID NO: 1446 - DNA, 20 bp, Artificial sequence
  Synthetic oligonucleotide
tttatatggacacaggctca

SEQ ID NO: 1447 - DNA, 20 bp, Artificial sequence
  Synthetic oligonucleotide
tatgaccaccgcttcacagc

SEQ ID NO: 1448 - DNA, 20 bp, Artificial sequence
  Synthetic oligonucleotide
ctgtcagctcagtgaagcgc

SEQ ID NO: 1449 - DNA, 20 bp, Artificial sequence
  Synthetic oligonucleotide
cactcactgttgcacacaca

SEQ ID NO: 1450 - DNA, 20 bp, Artificial sequence
  Synthetic oligonucleotide
acacaggcgcatccacaagc

SEQ ID NO: 1451 - DNA, 20 bp, Artificial sequence
  Synthetic oligonucleotide
gacttgtctggaggatgagc

SEQ ID NO: 1452 - DNA, 20 bp, Artificial sequence
  Synthetic oligonucleotide
cagtagagcagcaggaggat

SEQ ID NO: 1453 - DNA, 20 bp, Artificial sequence
  Synthetic oligonucleotide
ggacacattcctgggtccag

SEQ ID NO: 1454 - DNA, 20 bp, Artificial sequence
  Synthetic oligonucleotide
ggtgaggagtagagggccac

SEQ ID NO: 1455 - DNA, 20 bp, Artificial sequence
  Synthetic oligonucleotide
tctctcagttgcaatctctg

SEQ ID NO: 1456 - DNA, 20 bp, Artificial sequence
  Synthetic oligonucleotide
gagttcgaatgctctcttgt

SEQ ID NO: 1457 - DNA, 20 bp, Artificial sequence
  Synthetic oligonucleotide
cccacaggcagggctacctt

SEQ ID NO: 1458 - DNA, 20 bp, Artificial sequence
  Synthetic oligonucleotide
tacttttgaaagcaatagtg

SEQ ID NO: 1459 - DNA, 20 bp, Artificial sequence
  Synthetic oligonucleotide
cttagaacagaacagtatca

SEQ ID NO: 1460 - DNA, 20 bp, Artificial sequence
  Synthetic oligonucleotide
tctggacttcggctctctca

SEQ ID NO: 1461 - DNA, 20 bp, Artificial sequence
  Synthetic oligonucleotide
aaacagactggcagaggcat

SEQ ID NO: 1462 - DNA, 20 bp, Artificial sequence
  Synthetic oligonucleotide
gagctgtggtgttctctacg

SEQ ID NO: 1463 - DNA, 20 bp, Artificial sequence
  Synthetic oligonucleotide
tgtcctccactaggaatggc

SEQ ID NO: 1464 - DNA, 20 bp, Artificial sequence
  Synthetic oligonucleotide
tcacactcctcagctaggtg

SEQ ID NO: 1465 - DNA, 20 bp, Artificial sequence
  Synthetic oligonucleotide
ggcctcaccctgggttctaa

SEQ ID NO: 1466 - DNA, 20 bp, Artificial sequence
  Synthetic oligonucleotide
ttaggcgagcggaggcctgg

SEQ ID NO: 1467 - DNA, 20 bp, Artificial sequence
  Synthetic oligonucleotide
cacactgacagctgcatctg

SEQ ID NO: 1468 - DNA, 20 bp, Artificial sequence
  Synthetic oligonucleotide
gcacaacacctggtcagcaa

SEQ ID NO: 1469 - DNA, 20 bp, Artificial sequence
  Synthetic oligonucleotide
gttggccctggctgggactt

SEQ ID NO: 1470 - DNA, 20 bp, Artificial sequence
  Synthetic oligonucleotide
gaaatcagggaggtgagcag

SEQ ID NO: 1471 - DNA, 20 bp, Artificial sequence
  Synthetic oligonucleotide
ggtttcgaggcccggccccc

SEQ ID NO: 1472 - DNA, 20 bp, Artificial sequence
  Synthetic oligonucleotide
atggagccggccggtcccgc

SEQ ID NO: 1473 - DNA, 20 bp, Artificial sequence
  Synthetic oligonucleotide
tgtgatgagggctcaccggt

SEQ ID NO: 1474 - DNA, 20 bp, Artificial sequence
  Synthetic oligonucleotide
ctaccgtgaggcagcaggga

SEQ ID NO: 1475 - DNA, 20 bp, Artificial sequence
  Synthetic oligonucleotide
tgtgctgggcattgaggtgg

SEQ ID NO: 1476 - DNA, 20 bp, Artificial sequence
  Synthetic oligonucleotide
ggccttgaggcctaatcaat

SEQ ID NO: 1477 - DNA, 20 bp, Artificial sequence
  Synthetic oligonucleotide
tgggtgaggtgaggagtcca

SEQ ID NO: 1478 - DNA, 20 bp, Artificial sequence
  Synthetic oligonucleotide
aggcagaagagatgggtgag

SEQ ID NO: 1479 - DNA, 20 bp, Artificial sequence
  Synthetic oligonucleotide
gccccgcccgagagagaaaa

SEQ ID NO: 1480 - DNA, 20 bp, Artificial sequence
  Synthetic oligonucleotide
atcatttcagggccaatgca

SEQ ID NO: 1481 - DNA, 20 bp, Artificial sequence
  Synthetic oligonucleotide
tgttccttagctaagaatca

SEQ ID NO: 1482 - DNA, 20 bp, Artificial sequence
  Synthetic oligonucleotide
tccagaagaagaggaatttt

SEQ ID NO: 1483 - DNA, 20 bp, Artificial sequence
  Synthetic oligonucleotide
aattaagtcctgagacatgc

SEQ ID NO: 1484 - DNA, 20 bp, Artificial sequence
  Synthetic oligonucleotide
agtcagcctggttagccttt

SEQ ID NO: 1485 - DNA, 20 bp, Artificial sequence
  Synthetic oligonucleotide
agtgacctgtgactatctag

SEQ ID NO: 1486 - DNA, 20 bp, Artificial sequence
  Synthetic oligonucleotide
tctgccgaaggaaggaagga

SEQ ID NO: 1487 - DNA, 20 bp, Artificial sequence
  Synthetic oligonucleotide
tccgtcgaaagcaggcaagc

SEQ ID NO: 1488 - DNA, 20 bp, Artificial sequence
  Synthetic oligonucleotide
ggtattgaaatcaggagacc

SEQ ID NO: 1489 - DNA, 20 bp, Artificial sequence
  Synthetic oligonucleotide
caatagtgctgctgccagag

SEQ ID NO: 1490 - DNA, 20 bp, Artificial sequence
  Synthetic oligonucleotide
gaacctatgcaaccgagcag

SEQ ID NO: 1491 - DNA, 20 bp, Artificial sequence
  Synthetic oligonucleotide
tatgtgccagccccaggctt

SEQ ID NO: 1492 - DNA, 20 bp, Artificial sequence
  Synthetic oligonucleotide
tggtaccaaggctcccctta

SEQ ID NO: 1493 - DNA, 20 bp, Artificial sequence
  Synthetic oligonucleotide
gcccccgagtttgagggtga

SEQ ID NO: 1494 - DNA, 20 bp, Artificial sequence
  Synthetic oligonucleotide
gttggaagtgaaagctacta

SEQ ID NO: 1495 - DNA, 20 bp, Artificial sequence
  Synthetic oligonucleotide
agctcccactgtggttggag

SEQ ID NO: 1496 - DNA, 20 bp, Artificial sequence
  Synthetic oligonucleotide
tgcctggcgagtggtaagct

SEQ ID NO: 1497 - DNA, 20 bp, Artificial sequence
  Synthetic oligonucleotide
cttgatagtaaccacagctg

SEQ ID NO: 1498 - DNA, 20 bp, Artificial sequence
  Synthetic oligonucleotide
agttaggagttcacacagac

SEQ ID NO: 1499 - DNA, 20 bp, Artificial sequence
  Synthetic oligonucleotide
gcaacagtttccataacaac

SEQ ID NO: 1500 - DNA, 20 bp, Artificial sequence
  Synthetic oligonucleotide
catctctggcaacagtttcc

SEQ ID NO: 1501 - DNA, 20 bp, Artificial sequence
  Synthetic oligonucleotide
gttcccagatactccgagag

SEQ ID NO: 1502 - DNA, 20 bp, Artificial sequence
  Synthetic oligonucleotide
aaggcacagttcccagatac

SEQ ID NO: 1503 - DNA, 20 bp, Artificial sequence
  Synthetic oligonucleotide
ttcctccagcagcctgagga

SEQ ID NO: 1504 - DNA, 20 bp, Artificial sequence
  Synthetic oligonucleotide
agttttcctccagcagcctg

SEQ ID NO: 1505 - DNA, 20 bp, Artificial sequence
  Synthetic oligonucleotide
atcaagctcccacctgccca

SEQ ID NO: 1506 - DNA, 20 bp, Artificial sequence
  Synthetic oligonucleotide
tgagaatcaagctcccacct

SEQ ID NO: 1507 - DNA, 20 bp, Artificial sequence
  Synthetic oligonucleotide
tttcctcagcgactaaaggc

SEQ ID NO: 1508 - DNA, 20 bp, Artificial sequence
  Synthetic oligonucleotide
cgcagcatttgtctttattt

SEQ ID NO: 1509 - DNA, 20 bp, Artificial sequence
  Synthetic oligonucleotide
ggaagggcgcagcatttgtc

SEQ ID NO: 1510 - DNA, 20 bp, Artificial sequence
  Synthetic oligonucleotide
ttgagatatcttgtgacctt

SEQ ID NO: 1511 - DNA, 20 bp, Artificial sequence
  Synthetic oligonucleotide
aggcttttgagatatcttgt

SEQ ID NO: 1512 - DNA, 20 bp, Artificial sequence
  Synthetic oligonucleotide
ttgtgaggcttttgagatat

SEQ ID NO: 1513 - DNA, 20 bp, Artificial sequence
  Synthetic oligonucleotide
ccaagtccttggccttgagg

SEQ ID NO: 1514 - DNA, 20 bp, Artificial sequence
  Synthetic oligonucleotide
tggagggtgacccaagtcct

SEQ ID NO: 1515 - DNA, 20 bp, Artificial sequence
  Synthetic oligonucleotide
ttagtttggagggtgaccca

SEQ ID NO: 1516 - DNA, 20 bp, Artificial sequence
  Synthetic oligonucleotide
cttttaccaagctggaaatg

SEQ ID NO: 1517 - DNA, 20 bp, Artificial sequence
  Synthetic oligonucleotide
tttccttttaccaagctgga

SEQ ID NO: 1518 - DNA, 20 bp, Artificial sequence
  Synthetic oligonucleotide
tctcgggcactccttcttgg

SEQ ID NO: 1519 - DNA, 20 bp, Artificial sequence
  Synthetic oligonucleotide
cccatcaagaggtagggagg

SEQ ID NO: 1520 - DNA, 20 bp, Artificial sequence
  Synthetic oligonucleotide
gaccctggactcctggcaga

SEQ ID NO: 1521 - DNA, 20 bp, Artificial sequence
  Synthetic oligonucleotide
ccagccatgaatgaaacaca

SEQ ID NO: 1522 - DNA, 20 bp, Artificial sequence
  Synthetic oligonucleotide
ggctcagaataggtgagctc

SEQ ID NO: 1523 - DNA, 20 bp, Artificial sequence
  Synthetic oligonucleotide
gtcacaagctggtggcaggc

SEQ ID NO: 1524 - DNA, 20 bp, Artificial sequence
  Synthetic oligonucleotide
tttattatgaccaccgcttc

SEQ ID NO: 1525 - DNA, 20 bp, Artificial sequence
  Synthetic oligonucleotide
atgtcctgtcagctcagtga

SEQ ID NO: 1526 - DNA, 20 bp, Artificial sequence
  Synthetic oligonucleotide
catacactcactgttgcaca

SEQ ID NO: 1527 - DNA, 20 bp, Artificial sequence
  Synthetic oligonucleotide
gtgcacctgcttctgctcac

SEQ ID NO: 1528 - DNA, 20 bp, Artificial sequence
  Synthetic oligonucleotide
aggacttgtctggaggatga

SEQ ID NO: 1529 - DNA, 20 bp, Artificial sequence
  Synthetic oligonucleotide
tgaggcagctgtcacagaga

SEQ ID NO: 1530 - DNA, 20 bp, Artificial sequence
  Synthetic oligonucleotide
catcctggagcctggagtgg

SEQ ID NO: 1531 - DNA, 20 bp, Artificial sequence
  Synthetic oligonucleotide
aatctctgtgttgagctttc

SEQ ID NO: 1532 - DNA, 20 bp, Artificial sequence
  Synthetic oligonucleotide
ctctctcagttgcaatctct

SEQ ID NO: 1533 - DNA, 20 bp, Artificial sequence
  Synthetic oligonucleotide
cggccaggagttcgaatgct

SEQ ID NO: 1534 - DNA, 20 bp, Artificial sequence
  Synthetic oligonucleotide
tggcccacaggcagggctac

SEQ ID NO: 1535 - DNA, 20 bp, Artificial sequence
  Synthetic oligonucleotide
tgggtacttttgaaagcaat

SEQ ID NO: 1536 - DNA, 20 bp, Artificial sequence
  Synthetic oligonucleotide
aaaagcacagggcttagaac

SEQ ID NO: 1537 - DNA, 20 bp, Artificial sequence
  Synthetic oligonucleotide
ctctctggacttcggctctc

SEQ ID NO: 1538 - DNA, 20 bp, Artificial sequence
  Synthetic oligonucleotide
ggcatatggtagaggctcag

SEQ ID NO: 1539 - DNA, 20 bp, Artificial sequence
  Synthetic oligonucleotide
tataagctctgagctgtggt

SEQ ID NO: 1540 - DNA, 20 bp, Artificial sequence
  Synthetic oligonucleotide
ggtgccctggctaggctagc

SEQ ID NO: 1541 - DNA, 20 bp, Artificial sequence
  Synthetic oligonucleotide
ctcacactcctcagctaggt

SEQ ID NO: 1542 - DNA, 20 bp, Artificial sequence
  Synthetic oligonucleotide
gcggaggcctgggtgttttg

SEQ ID NO: 1543 - DNA, 20 bp, Artificial sequence
  Synthetic oligonucleotide
gtcttaggcgagcggaggcc

SEQ ID NO: 1544 - DNA, 20 bp, Artificial sequence
  Synthetic oligonucleotide
aacagtgccacagaatccag

SEQ ID NO: 1545 - DNA, 20 bp, Artificial sequence
  Synthetic oligonucleotide
gacccatggatgcgggcagg

SEQ ID NO: 1546 - DNA, 20 bp, Artificial sequence
  Synthetic oligonucleotide
cgttggccctggctgggact

SEQ ID NO: 1547 - DNA, 20 bp, Artificial sequence
  Synthetic oligonucleotide
tctgtcaggtctgcaaacta

SEQ ID NO: 1548 - DNA, 20 bp, Artificial sequence
  Synthetic oligonucleotide
gggaggtttcgaggcccggc

SEQ ID NO: 1549 - DNA, 20 bp, Artificial sequence
  Synthetic oligonucleotide
ggatggagccggccggtccc

SEQ ID NO: 1550 - DNA, 20 bp, Artificial sequence
  Synthetic oligonucleotide
gctgtgatgagggctcaccg

SEQ ID NO: 1551 - DNA, 20 bp, Artificial sequence
  Synthetic oligonucleotide
ctgaagggagcaagatgagc

SEQ ID NO: 1552 - DNA, 20 bp, Artificial sequence
  Synthetic oligonucleotide
actgtgctgggcattgaggt

SEQ ID NO: 1553 - DNA, 20 bp, Artificial sequence
  Synthetic oligonucleotide
gagtatgcctcttagtttgg

SEQ ID NO: 1554 - DNA, 20 bp, Artificial sequence
  Synthetic oligonucleotide
atgggtgaggtgaggagtcc

SEQ ID NO: 1555 - DNA, 20 bp, Artificial sequence
  Synthetic oligonucleotide
gtggtgaagaaagttccaag

SEQ ID NO: 1556 - DNA, 20 bp, Artificial sequence
  Synthetic oligonucleotide
cgccccgcccgagagagaaa

SEQ ID NO: 1557 - DNA, 20 bp, Artificial sequence
  Synthetic oligonucleotide
gaatcatttcagggccaatg

SEQ ID NO: 1558 - DNA, 20 bp, Artificial sequence
  Synthetic oligonucleotide
tttgttccttagctaagaat

SEQ ID NO: 1559 - DNA, 20 bp, Artificial sequence
  Synthetic oligonucleotide
agtccagaagaagaggaatt

SEQ ID NO: 1560 - DNA, 20 bp, Artificial sequence
  Synthetic oligonucleotide
ctgatgctgaattaagtcct

SEQ ID NO: 1561 - DNA, 20 bp, Artificial sequence
  Synthetic oligonucleotide
ctagtcagcctggttagcct

SEQ ID NO: 1562 - DNA, 20 bp, Artificial sequence
  Synthetic oligonucleotide
ccatttatctgtgctttagt

SEQ ID NO: 1563 - DNA, 20 bp, Artificial sequence
  Synthetic oligonucleotide
cgctctgccgaaggaaggaa

SEQ ID NO: 1564 - DNA, 20 bp, Artificial sequence
  Synthetic oligonucleotide
aaatcaggagaccaggaggg

SEQ ID NO: 1565 - DNA, 20 bp, Artificial sequence
  Synthetic oligonucleotide
cagcacggtattgaaatcag

SEQ ID NO: 1566 - DNA, 20 bp, Artificial sequence
  Synthetic oligonucleotide
ttccaaacgggctggagagc

SEQ ID NO: 1567 - DNA, 20 bp, Artificial sequence
  Synthetic oligonucleotide
atggactttcagggcatgag

SEQ ID NO: 1568 - DNA, 20 bp, Artificial sequence
  Synthetic oligonucleotide
ggagggactgaggaaacgga

SEQ ID NO: 1569 - DNA, 20 bp, Artificial sequence
  Synthetic oligonucleotide
gtgtgtattaggatcccatc

SEQ ID NO: 1570 - DNA, 20 bp, Artificial sequence
  Synthetic oligonucleotide
agcaaggcccccgagtttga

SEQ ID NO: 1571 - DNA, 20 bp, Artificial sequence
  Synthetic oligonucleotide
gctagagttggaagtgaaag

SEQ ID NO: 1572 - DNA, 20 bp, Artificial sequence
  Synthetic oligonucleotide
atgagctcccactgtggttg

SEQ ID NO: 1573 - DNA, 20 bp, Artificial sequence
  Synthetic oligonucleotide
gataacactgggaaagcatt

SEQ ID NO: 1574 - DNA, 20 bp, Artificial sequence
  Synthetic oligonucleotide
aaccttgggaagtccccgac

SEQ ID NO: 1575 - DNA, 20 bp, Artificial sequence
  Synthetic oligonucleotide
acagttaggagttcacacag

SEQ ID NO: 1576 - DNA, 20 bp, Artificial sequence
  Synthetic oligonucleotide
ctggctctgctcgctcctgg

SEQ ID NO: 1577 - DNA, 20 bp, Artificial sequence
  Synthetic oligonucleotide
ctccatcatctctgcccgct

SEQ ID NO: 1578 - DNA, 20 bp, Artificial sequence
  Synthetic oligonucleotide
ctataggcagccaggttgtt

SEQ ID NO: 1579 - DNA, 20 bp, Artificial sequence
  Synthetic oligonucleotide
atctctttcagggctgcggt

SEQ ID NO: 1580 - DNA, 20 bp, Artificial sequence
  Synthetic oligonucleotide
tgaggctctgcccctcttcc

SEQ ID NO: 1581 - DNA, 20 bp, Artificial sequence
  Synthetic oligonucleotide
ccttgtgctcctgcttggac

SEQ ID NO: 1582 - DNA, 20 bp, Artificial sequence
  Synthetic oligonucleotide
aggcctgatactgacggagc

SEQ ID NO: 1583 - DNA, 20 bp, Artificial sequence
  Synthetic oligonucleotide
gtaggtgccccccgccctcc

SEQ ID NO: 1584 - DNA, 20 bp, Artificial sequence
  Synthetic oligonucleotide
agaacctccatctctggcaa

SEQ ID NO: 1585 - DNA, 20 bp, Artificial sequence
  Synthetic oligonucleotide
ccaaaagacaaaacaagcct

SEQ ID NO: 1586 - DNA, 20 bp, Artificial sequence
  Synthetic oligonucleotide
catagggatatcccacctca

SEQ ID NO: 1587 - DNA, 20 bp, Artificial sequence
  Synthetic oligonucleotide
gtcatcgctcaggaggtcct

SEQ ID NO: 1588 - DNA, 20 bp, Artificial sequence
  Synthetic oligonucleotide
ctatccctcccagcacctca

SEQ ID NO: 1589 - DNA, 20 bp, Artificial sequence
  Synthetic oligonucleotide
aggatgagtcacttccttaa

SEQ ID NO: 1590 - DNA, 20 bp, Artificial sequence
  Synthetic oligonucleotide
gtcatgccctgcccccatgg

SEQ ID NO: 1591 - DNA, 20 bp, Artificial sequence
  Synthetic oligonucleotide
aggaagaggcctttagaaat

SEQ ID NO: 1592 - DNA, 20 bp, Artificial sequence
  Synthetic oligonucleotide
gtgtgtgagtaagaagggac

SEQ ID NO: 1593 - DNA, 20 bp, Artificial sequence
  Synthetic oligonucleotide
tcagttttacaattgtaaaa

SEQ ID NO: 1594 - DNA, 20 bp, Artificial sequence
  Synthetic oligonucleotide
ggagaaccctgaagtgggcc

SEQ ID NO: 1595 - DNA, 20 bp, Artificial sequence
  Synthetic oligonucleotide
gtattgtgaggcttttgaga

SEQ ID NO: 1596 - DNA, 20 bp, Artificial sequence
  Synthetic oligonucleotide
gaggctcactccctgtcaag

SEQ ID NO: 1597 - DNA, 20 bp, Artificial sequence
  Synthetic oligonucleotide
aacaagctctgccagtttaa

SEQ ID NO: 1598 - DNA, 20 bp, Artificial sequence
  Synthetic oligonucleotide
tgagtcagcactgagctgag

SEQ ID NO: 1599 - DNA, 20 bp, Artificial sequence
  Synthetic oligonucleotide
caagagctgcggtcctgagg

SEQ ID NO: 1600 - DNA, 20 bp, Artificial sequence
  Synthetic oligonucleotide
tttaacattaagagcaggga

SEQ ID NO: 1601 - DNA, 20 bp, Artificial sequence
  Synthetic oligonucleotide
ctggtatgataggctctggc

SEQ ID NO: 1602 - DNA, 20 bp, Artificial sequence
  Synthetic oligonucleotide
cagacagggcagatgtcaag

SEQ ID NO: 1603 - DNA, 20 bp, Artificial sequence
  Synthetic oligonucleotide
ccccttctgctcacaaggcc

SEQ ID NO: 1604 - DNA, 20 bp, Artificial sequence
  Synthetic oligonucleotide
catgcgggcatcagatcccc

SEQ ID NO: 1605 - DNA, 20 bp, Artificial sequence
  Synthetic oligonucleotide
tcgctgcccacagtcacaaa

SEQ ID NO: 1606 - DNA, 20 bp, Artificial sequence
  Synthetic oligonucleotide
gtgctttgcgcccagacctg

SEQ ID NO: 1607 - DNA, 20 bp, Artificial sequence
  Synthetic oligonucleotide
gaaatgaattttattatgac

SEQ ID NO: 1608 - DNA, 20 bp, Artificial sequence
  Synthetic oligonucleotide
tccacaagcatacactcact

SEQ ID NO: 1609 - DNA, 20 bp, Artificial sequence
  Synthetic oligonucleotide
tgcctcagtctcccttgagg

SEQ ID NO: 1610 - DNA, 20 bp, Artificial sequence
  Synthetic oligonucleotide
ccattcctcagccttgcctt

SEQ ID NO: 1611 - DNA, 20 bp, Artificial sequence
  Synthetic oligonucleotide
gtctctctcagtctcagctt

SEQ ID NO: 1612 - DNA, 20 bp, Artificial sequence
  Synthetic oligonucleotide
gtctttctgtttgtctttca

SEQ ID NO: 1613 - DNA, 20 bp, Artificial sequence
  Synthetic oligonucleotide
ccattgtgtcctcttctgcc

SEQ ID NO: 1614 - DNA, 20 bp, Artificial sequence
  Synthetic oligonucleotide
ttctcttgtacagagcaaga

SEQ ID NO: 1615 - DNA, 20 bp, Artificial sequence
  Synthetic oligonucleotide
ctgggcaagccatctcactt

SEQ ID NO: 1616 - DNA, 20 bp, Artificial sequence
  Synthetic oligonucleotide
cagtatcagctactactaat

SEQ ID NO: 1617 - DNA, 20 bp, Artificial sequence
  Synthetic oligonucleotide
aaggtaatccatgaaaagca

SEQ ID NO: 1618 - DNA, 20 bp, Artificial sequence
  Synthetic oligonucleotide
gacttcggctctctcatctg

SEQ ID NO: 1619 - DNA, 20 bp, Artificial sequence
  Synthetic oligonucleotide
ccaggtcagacacctctctg

SEQ ID NO: 1620 - DNA, 20 bp, Artificial sequence
  Synthetic oligonucleotide
aagctctgagctgtggtgtt

SEQ ID NO: 1621 - DNA, 20 bp, Artificial sequence
  Synthetic oligonucleotide
cccaaatgccccctctacag

SEQ ID NO: 1622 - DNA, 20 bp, Artificial sequence
  Synthetic oligonucleotide
ccctgcctctctgtgctttt

SEQ ID NO: 1623 - DNA, 20 bp, Artificial sequence
  Synthetic oligonucleotide
aggtcctcccagccccatcg

SEQ ID NO: 1624 - DNA, 20 bp, Artificial sequence
  Synthetic oligonucleotide
tccacactgacagctgcatc

SEQ ID NO: 1625 - DNA, 20 bp, Artificial sequence
  Synthetic oligonucleotide
tagcgggctgccagacctca

SEQ ID NO: 1626 - DNA, 20 bp, Artificial sequence
  Synthetic oligonucleotide
ccctggccgcgctcaccgtg

SEQ ID NO: 1627 - DNA, 20 bp, Artificial sequence
  Synthetic oligonucleotide
ttcaggccccgccctcgacc

SEQ ID NO: 1628 - DNA, 20 bp, Artificial sequence
  Synthetic oligonucleotide
agggagcaagatgagctcta

SEQ ID NO: 1629 - DNA, 20 bp, Artificial sequence
  Synthetic oligonucleotide
gaatccatccatccattcag

SEQ ID NO: 1630 - DNA, 20 bp, Artificial sequence
  Synthetic oligonucleotide
ggtgaggagtccaatcttgg

SEQ ID NO: 1631 - DNA, 20 bp, Artificial sequence
  Synthetic oligonucleotide
aagtggtgaagaaagttcca

SEQ ID NO: 1632 - DNA, 20 bp, Artificial sequence
  Synthetic oligonucleotide
catcatgacaacttgaacgc

SEQ ID NO: 1633 - DNA, 20 bp, Artificial sequence
  Synthetic oligonucleotide
cctccccccgccccgcccga

SEQ ID NO: 1634 - DNA, 20 bp, Artificial sequence
  Synthetic oligonucleotide
gctaagaatcatttcagggc

SEQ ID NO: 1635 - DNA, 20 bp, Artificial sequence
  Synthetic oligonucleotide
ctaaatattctagtccagaa

SEQ ID NO: 1636 - DNA, 20 bp, Artificial sequence
  Synthetic oligonucleotide
tggttagcctttctgatgct

SEQ ID NO: 1637 - DNA, 20 bp, Artificial sequence
  Synthetic oligonucleotide
ggcagtattacctctactag

SEQ ID NO: 1638 - DNA, 20 bp, Artificial sequence
  Synthetic oligonucleotide
gtgacctgtgactatctagg

SEQ ID NO: 1639 - DNA, 20 bp, Artificial sequence
  Synthetic oligonucleotide
tgccatttatctgtgcttta

SEQ ID NO: 1640 - DNA, 20 bp, Artificial sequence
  Synthetic oligonucleotide
taaaggctgttaaacatgtg

SEQ ID NO: 1641 - DNA, 20 bp, Artificial sequence
  Synthetic oligonucleotide
accagccacatgactctggg

SEQ ID NO: 1642 - DNA, 20 bp, Artificial sequence
  Synthetic oligonucleotide
cacggtattgaaatcaggag

SEQ ID NO: 1643 - DNA, 20 bp, Artificial sequence
  Synthetic oligonucleotide
ctgctgccagagtcctggct

SEQ ID NO: 1644 - DNA, 20 bp, Artificial sequence
  Synthetic oligonucleotide
cacccccctccccatcatga

SEQ ID NO: 1645 - DNA, 20 bp, Artificial sequence
  Synthetic oligonucleotide
agaggaggcctctcatggac

SEQ ID NO: 1646 - DNA, 20 bp, Artificial sequence
  Synthetic oligonucleotide
aacggaattacattcagttt

SEQ ID NO: 1647 - DNA, 20 bp, Artificial sequence
  Synthetic oligonucleotide
tattaggatcccatctagtg

SEQ ID NO: 1648 - DNA, 20 bp, Artificial sequence
  Synthetic oligonucleotide
aaagctactaactttaattc

SEQ ID NO: 1649 - DNA, 20 bp, Artificial sequence
  Synthetic oligonucleotide
caagctggaaatggaaagcc

SEQ ID NO: 1650 - DNA, 20 bp, Artificial sequence
  Synthetic oligonucleotide
agtggtaagctgctggagta

SEQ ID NO: 1651 - DNA, 20 bp, Artificial sequence
  Synthetic oligonucleotide
ccgacttcccaggtcttact

SEQ ID NO: 1652 - DNA, 20 bp, Artificial sequence
  Synthetic oligonucleotide
atgcgagggctttatgaagg

SEQ ID NO: 1653 - DNA, 20 bp, Artificial sequence
  Synthetic oligonucleotide
tctctgcccgctcactggcc

SEQ ID NO: 1654 - DNA, 20 bp, Artificial sequence
  Synthetic oligonucleotide
tgttctcggcttccagcctc

SEQ ID NO: 1655 - DNA, 20 bp, Artificial sequence
  Synthetic oligonucleotide
ctctttcagggctgcggtga

SEQ ID NO: 1656 - DNA, 20 bp, Artificial sequence
  Synthetic oligonucleotide
ctcttcctccagccgcgcca

SEQ ID NO: 1657 - DNA, 20 bp, Artificial sequence
  Synthetic oligonucleotide
tcctgcttggactccttaat

SEQ ID NO: 1658 - DNA, 20 bp, Artificial sequence
  Synthetic oligonucleotide
cagcaagctgacctagggac

SEQ ID NO: 1659 - DNA, 20 bp, Artificial sequence
  Synthetic oligonucleotide
ccccccgccctcctcccctt

SEQ ID NO: 1660 - DNA, 20 bp, Artificial sequence
  Synthetic oligonucleotide
cctccatctctggcaacagt

SEQ ID NO: 1661 - DNA, 20 bp, Artificial sequence
  Synthetic oligonucleotide
aaaagacaaaacaagcctct

SEQ ID NO: 1662 - DNA, 20 bp, Artificial sequence
  Synthetic oligonucleotide
tagggatatcccacctcata

SEQ ID NO: 1663 - DNA, 20 bp, Artificial sequence
  Synthetic oligonucleotide
caggtgactgccccaggtgg

SEQ ID NO: 1664 - DNA, 20 bp, Artificial sequence
  Synthetic oligonucleotide
tccctcccagcacctcatcc

SEQ ID NO: 1665 - DNA, 20 bp, Artificial sequence
  Synthetic oligonucleotide
atgagtcacttccttaattc

SEQ ID NO: 1666 - DNA, 20 bp, Artificial sequence
  Synthetic oligonucleotide
tggatacatcccctttctct

SEQ ID NO: 1667 - DNA, 20 bp, Artificial sequence
  Synthetic oligonucleotide
gaagaggcctttagaaatgg

SEQ ID NO: 1668 - DNA, 20 bp, Artificial sequence
  Synthetic oligonucleotide
gtgagtaagaagggaccgca

SEQ ID NO: 1669 - DNA, 20 bp, Artificial sequence
  Synthetic oligonucleotide
tacaattgtaaaatagggca

SEQ ID NO: 1670 - DNA, 20 bp, Artificial sequence
  Synthetic oligonucleotide
accagtctgctcaccagtct

SEQ ID NO: 1671 - DNA, 20 bp, Artificial sequence
  Synthetic oligonucleotide
gatatcttgtgaccttgtga

SEQ ID NO: 1672 - DNA, 20 bp, Artificial sequence
  Synthetic oligonucleotide
ggctcactccctgtcaagct

SEQ ID NO: 1673 - DNA, 20 bp, Artificial sequence
  Synthetic oligonucleotide
caagctctgccagtttaatg

SEQ ID NO: 1674 - DNA, 20 bp, Artificial sequence
  Synthetic oligonucleotide
ctgagctgagcgatggagcc

SEQ ID NO: 1675 - DNA, 20 bp, Artificial sequence
  Synthetic oligonucleotide
tgcggtcctgagggaagaat

SEQ ID NO: 1676 - DNA, 20 bp, Artificial sequence
  Synthetic oligonucleotide
taacattaagagcagggaac

SEQ ID NO: 1677 - DNA, 20 bp, Artificial sequence
  Synthetic oligonucleotide
agtgtcacgaaggcccccag

SEQ ID NO: 1678 - DNA, 20 bp, Artificial sequence
  Synthetic oligonucleotide
ggaccagggcctagcaggac

SEQ ID NO: 1679 - DNA, 20 bp, Artificial sequence
  Synthetic oligonucleotide
ctgctcacaaggcccccctt

SEQ ID NO: 1680 - DNA, 20 bp, Artificial sequence
  Synthetic oligonucleotide
ggttcggcccctccctgaga

SEQ ID NO: 1681 - DNA, 20 bp, Artificial sequence
  Synthetic oligonucleotide
gccatgaatgaaacacaggg

SEQ ID NO: 1682 - DNA, 20 bp, Artificial sequence
  Synthetic oligonucleotide
cctgcctgctctttccctca

SEQ ID NO: 1683 - DNA, 20 bp, Artificial sequence
  Synthetic oligonucleotide
aattttattatgaccaccgc

SEQ ID NO: 1684 - DNA, 20 bp, Artificial sequence
  Synthetic oligonucleotide
aagcatacactcactgttgc

SEQ ID NO: 1685 - DNA, 20 bp, Artificial sequence
  Synthetic oligonucleotide
cagctgtcacagagaccacc

SEQ ID NO: 1686 - DNA, 20 bp, Artificial sequence
  Synthetic oligonucleotide
ttcctcagccttgccttacc

SEQ ID NO: 1687 - DNA, 20 bp, Artificial sequence
  Synthetic oligonucleotide
tctcagttgcaatctctgtg

SEQ ID NO: 1688 - DNA, 20 bp, Artificial sequence
  Synthetic oligonucleotide
tttcatttcctgtctctacc

SEQ ID NO: 1689 - DNA, 20 bp, Artificial sequence
  Synthetic oligonucleotide
tgtcctcttctgcctgcccc

SEQ ID NO: 1690 - DNA, 20 bp, Artificial sequence
  Synthetic oligonucleotide
caggcagggctaccttggag

SEQ ID NO: 1691 - DNA, 20 bp, Artificial sequence
  Synthetic oligonucleotide
atctcacttctctggtgaaa

SEQ ID NO: 1692 - DNA, 20 bp, Artificial sequence
  Synthetic oligonucleotide
ataatagcaatagtagcagt

SEQ ID NO: 1693 - DNA, 20 bp, Artificial sequence
  Synthetic oligonucleotide
taatccatgaaaagcacagg

SEQ ID NO: 1694 - DNA, 20 bp, Artificial sequence
  Synthetic oligonucleotide
tcggctctctcatctgtcaa

SEQ ID NO: 1695 - DNA, 20 bp, Artificial sequence
  Synthetic oligonucleotide
tcagacacctctctgtgtcc

SEQ ID NO: 1696 - DNA, 20 bp, Artificial sequence
  Synthetic oligonucleotide
ctgtggtgttctctacgggc

SEQ ID NO: 1697 - DNA, 20 bp, Artificial sequence
  Synthetic oligonucleotide
caaatgccccctctacagtg

SEQ ID NO: 1698 - DNA, 20 bp, Artificial sequence
  Synthetic oligonucleotide
ctctctgtgcttttctgcct

SEQ ID NO: 1699 - DNA, 20 bp, Artificial sequence
  Synthetic oligonucleotide
atcgggccctcaccctgctc

SEQ ID NO: 1700 - DNA, 20 bp, Artificial sequence
  Synthetic oligonucleotide
taggcgagcggaggcctggg

SEQ ID NO: 1701 - DNA, 20 bp, Artificial sequence
  Synthetic oligonucleotide
gacctcagcacctagcacaa

SEQ ID NO: 1702 - DNA, 20 bp, Artificial sequence
  Synthetic oligonucleotide
tcaccgtgccgcgcagagac

SEQ ID NO: 1703 - DNA, 20 bp, Artificial sequence
  Synthetic oligonucleotide
gccccgccctcgacccaggt

SEQ ID NO: 1704 - DNA, 20 bp, Artificial sequence
  Synthetic oligonucleotide
gatgagctctaccgtgaggc

SEQ ID NO: 1705 - DNA, 20 bp, Artificial sequence
  Synthetic oligonucleotide
agtcatcaaacatctagtga

SEQ ID NO: 1706 - DNA, 20 bp, Artificial sequence
  Synthetic oligonucleotide
gaggagtccaatcttggctg

SEQ ID NO: 1707 - DNA, 20 bp, Artificial sequence
  Synthetic oligonucleotide
gtgaagaaagttccaaggag

SEQ ID NO: 1708 - DNA, 20 bp, Artificial sequence
  Synthetic oligonucleotide
tttccttgccaggaaagtct

SEQ ID NO: 1709 - DNA, 20 bp, Artificial sequence
  Synthetic oligonucleotide
ccccgccccgcccgagagag

SEQ ID NO: 1710 - DNA, 20 bp, Artificial sequence
  Synthetic oligonucleotide
taagaatcatttcagggcca

SEQ ID NO: 1711 - DNA, 20 bp, Artificial sequence
  Synthetic oligonucleotide
aatattctagtccagaagaa

SEQ ID NO: 1712 - DNA, 20 bp, Artificial sequence
  Synthetic oligonucleotide
ttagcctttctgatgctgaa

SEQ ID NO: 1713 - DNA, 20 bp, Artificial sequence
  Synthetic oligonucleotide
tattacctctactagtcagc

SEQ ID NO: 1714 - DNA, 20 bp, Artificial sequence
  Synthetic oligonucleotide
gacctgtgactatctaggat

SEQ ID NO: 1715 - DNA, 20 bp, Artificial sequence
  Synthetic oligonucleotide
catttatctgtgctttagtg

SEQ ID NO: 1716 - DNA, 20 bp, Artificial sequence
  Synthetic oligonucleotide
gctgttaaacatgtggcaca

SEQ ID NO: 1717 - DNA, 20 bp, Artificial sequence
  Synthetic oligonucleotide
cctacttctctaggtgggag

SEQ ID NO: 1718 - DNA, 20 bp, Artificial sequence
  Synthetic oligonucleotide
cggtattgaaatcaggagac

SEQ ID NO: 1719 - DNA, 20 bp, Artificial sequence
  Synthetic oligonucleotide
tttcagcccctctgcaagcc

SEQ ID NO: 1720 - DNA, 20 bp, Artificial sequence
  Synthetic oligonucleotide
cctccccatcatgagtatga

SEQ ID NO: 1721 - DNA, 20 bp, Artificial sequence
  Synthetic oligonucleotide
aggaggcctctcatggactt

SEQ ID NO: 1722 - DNA, 20 bp, Artificial sequence
  Synthetic oligonucleotide
aattacattcagtttccttg

SEQ ID NO: 1723 - DNA, 20 bp, Artificial sequence
  Synthetic oligonucleotide
ttaggatcccatctagtggc

SEQ ID NO: 1724 - DNA, 20 bp, Artificial sequence
  Synthetic oligonucleotide
tactaactttaattctcttt

SEQ ID NO: 1725 - DNA, 20 bp, Artificial sequence
  Synthetic oligonucleotide
aaatggaaagccctccccat

SEQ ID NO: 1726 - DNA, 20 bp, Artificial sequence
  Synthetic oligonucleotide
tggtaagctgctggagtaag

SEQ ID NO: 1727 - DNA, 20 bp, Artificial sequence
  Synthetic oligonucleotide
ttcccaggtcttacttttct

SEQ ID NO: 1728 - DNA, 20 bp, Artificial sequence
  Synthetic oligonucleotide
ggctctgctcgctcctggga

SEQ ID NO: 1729 - DNA, 20 bp, Artificial sequence
  Synthetic oligonucleotide
catcatctctgcccgctcac

SEQ ID NO: 1730 - DNA, 20 bp, Artificial sequence
  Synthetic oligonucleotide
aggttgttctcggcttccag

SEQ ID NO: 1731 - DNA, 20 bp, Artificial sequence
  Synthetic oligonucleotide
tctctttcagggctgcggtg

SEQ ID NO: 1732 - DNA, 20 bp, Artificial sequence
  Synthetic oligonucleotide
cctcttcctccagccgcgcc

SEQ ID NO: 1733 - DNA, 20 bp, Artificial sequence
  Synthetic oligonucleotide
cttgtgctcctgcttggact

SEQ ID NO: 1734 - DNA, 20 bp, Artificial sequence
  Synthetic oligonucleotide
actgacggagcctagggcag

SEQ ID NO: 1735 - DNA, 20 bp, Artificial sequence
  Synthetic oligonucleotide
aggtgccccccgccctcctc

SEQ ID NO: 1736 - DNA, 20 bp, Artificial sequence
  Synthetic oligonucleotide
acctccatctctggcaacag

SEQ ID NO: 1737 - DNA, 20 bp, Artificial sequence
  Synthetic oligonucleotide
caaaagacaaaacaagcctc

SEQ ID NO: 1738 - DNA, 20 bp, Artificial sequence
  Synthetic oligonucleotide
atagggatatcccacctcat

SEQ ID NO: 1739 - DNA, 20 bp, Artificial sequence
  Synthetic oligonucleotide
tcaggaggtccttctgggat

SEQ ID NO: 1740 - DNA, 20 bp, Artificial sequence
  Synthetic oligonucleotide
tatccctcccagcacctcat

SEQ ID NO: 1741 - DNA, 20 bp, Artificial sequence
  Synthetic oligonucleotide
gatgagtcacttccttaatt

SEQ ID NO: 1742 - DNA, 20 bp, Artificial sequence
  Synthetic oligonucleotide
tcatgccctgcccccatgga

SEQ ID NO: 1743 - DNA, 20 bp, Artificial sequence
  Synthetic oligonucleotide
ggaagaggcctttagaaatg

SEQ ID NO: 1744 - DNA, 20 bp, Artificial sequence
  Synthetic oligonucleotide
gtgtgagtaagaagggaccg

SEQ ID NO: 1745 - DNA, 20 bp, Artificial sequence
  Synthetic oligonucleotide
agttttacaattgtaaaata

SEQ ID NO: 1746 - DNA, 20 bp, Artificial sequence
  Synthetic oligonucleotide
atctctgggcacagatccca

SEQ ID NO: 1747 - DNA, 20 bp, Artificial sequence
  Synthetic oligonucleotide
agatatcttgtgaccttgtg

SEQ ID NO: 1748 - DNA, 20 bp, Artificial sequence
  Synthetic oligonucleotide
aggctcactccctgtcaagc

SEQ ID NO: 1749 - DNA, 20 bp, Artificial sequence
  Synthetic oligonucleotide
acaagctctgccagtttaat

SEQ ID NO: 1750 - DNA, 20 bp, Artificial sequence
  Synthetic oligonucleotide
actgagctgagcgatggagc

SEQ ID NO: 1751 - DNA, 20 bp, Artificial sequence
  Synthetic oligonucleotide
agctgcggtcctgagggaag

SEQ ID NO: 1752 - DNA, 20 bp, Artificial sequence
  Synthetic oligonucleotide
ttaacattaagagcagggaa

SEQ ID NO: 1753 - DNA, 20 bp, Artificial sequence
  Synthetic oligonucleotide
ggtatgataggctctggcta

SEQ ID NO: 1754 - DNA, 20 bp, Artificial sequence
  Synthetic oligonucleotide
agacagggcagatgtcaagc

SEQ ID NO: 1755 - DNA, 20 bp, Artificial sequence
  Synthetic oligonucleotide
tctgctcacaaggcccccct

SEQ ID NO: 1756 - DNA, 20 bp, Artificial sequence
  Synthetic oligonucleotide
gggaggttcggcccctccct

SEQ ID NO: 1757 - DNA, 20 bp, Artificial sequence
  Synthetic oligonucleotide
agccatgaatgaaacacagg

SEQ ID NO: 1758 - DNA, 20 bp, Artificial sequence
  Synthetic oligonucleotide
tgcgcccagacctgcctgct

SEQ ID NO: 1759 - DNA, 20 bp, Artificial sequence
  Synthetic oligonucleotide
aaatgaattttattatgacc

SEQ ID NO: 1760 - DNA, 20 bp, Artificial sequence
  Synthetic oligonucleotide
caagcatacactcactgttg

SEQ ID NO: 1761 - DNA, 20 bp, Artificial sequence
  Synthetic oligonucleotide
aggcagctgtcacagagacc

SEQ ID NO: 1762 - DNA, 20 bp, Artificial sequence
  Synthetic oligonucleotide
cattcctcagccttgcctta

SEQ ID NO: 1763 - DNA, 20 bp, Artificial sequence
  Synthetic oligonucleotide
tccctctctcagttgcaatc

SEQ ID NO: 1764 - DNA, 20 bp, Artificial sequence
  Synthetic oligonucleotide
tctttctgtttgtctttcat

SEQ ID NO: 1765 - DNA, 20 bp, Artificial sequence
  Synthetic oligonucleotide
gtgtcctcttctgcctgccc

SEQ ID NO: 1766 - DNA, 20 bp, Artificial sequence
  Synthetic oligonucleotide
tctcttgtacagagcaagaa

SEQ ID NO: 1767 - DNA, 20 bp, Artificial sequence
  Synthetic oligonucleotide
agccatctcacttctctggt

SEQ ID NO: 1768 - DNA, 20 bp, Artificial sequence
  Synthetic oligonucleotide
actactaataatagcaatag

SEQ ID NO: 1769 - DNA, 20 bp, Artificial sequence
  Synthetic oligonucleotide
gtaatccatgaaaagcacag

SEQ ID NO: 1770 - DNA, 20 bp, Artificial sequence
  Synthetic oligonucleotide
cttcggctctctcatctgtc

SEQ ID NO: 1771 - DNA, 20 bp, Artificial sequence
  Synthetic oligonucleotide
caggtcagacacctctctgt

SEQ ID NO: 1772 - DNA, 20 bp, Artificial sequence
  Synthetic oligonucleotide
gctctgagctgtggtgttct

SEQ ID NO: 1773 - DNA, 20 bp, Artificial sequence
  Synthetic oligonucleotide
ccaaatgccccctctacagt

SEQ ID NO: 1774 - DNA, 20 bp, Artificial sequence
  Synthetic oligonucleotide
cctctctgtgcttttctgcc

SEQ ID NO: 1775 - DNA, 20 bp, Artificial sequence
  Synthetic oligonucleotide
ggtcctcccagccccatcgg

SEQ ID NO: 1776 - DNA, 20 bp, Artificial sequence
  Synthetic oligonucleotide
cttaggcgagcggaggcctg

SEQ ID NO: 1777 - DNA, 20 bp, Artificial sequence
  Synthetic oligonucleotide
gccagacctcagcacctagc

SEQ ID NO: 1778 - DNA, 20 bp, Artificial sequence
  Synthetic oligonucleotide
gctcaccgtgccgcgcagag

SEQ ID NO: 1779 - DNA, 20 bp, Artificial sequence
  Synthetic oligonucleotide
tcaggccccgccctcgaccc

SEQ ID NO: 1780 - DNA, 20 bp, Artificial sequence
  Synthetic oligonucleotide
agatgagctctaccgtgagg

SEQ ID NO: 1781 - DNA, 20 bp, Artificial sequence
  Synthetic oligonucleotide
atccattcagtcatcaaaca

SEQ ID NO: 1782 - DNA, 20 bp, Artificial sequence
  Synthetic oligonucleotide
gtgaggagtccaatcttggc

SEQ ID NO: 1783 - DNA, 20 bp, Artificial sequence
  Synthetic oligonucleotide
ggtgaagaaagttccaagga

SEQ ID NO: 1784 - DNA, 20 bp, Artificial sequence
  Synthetic oligonucleotide
ttttccttgccaggaaagtc

SEQ ID NO: 1785 - DNA, 20 bp, Artificial sequence
  Synthetic oligonucleotide
cccccgccccgcccgagaga

SEQ ID NO: 1786 - DNA, 20 bp, Artificial sequence
  Synthetic oligonucleotide
ctaagaatcatttcagggcc

SEQ ID NO: 1787 - DNA, 20 bp, Artificial sequence
  Synthetic oligonucleotide
taaatattctagtccagaag

SEQ ID NO: 1788 - DNA, 20 bp, Artificial sequence
  Synthetic oligonucleotide
ggttagcctttctgatgctg

SEQ ID NO: 1789 - DNA, 20 bp, Artificial sequence
  Synthetic oligonucleotide
gtattacctctactagtcag

SEQ ID NO: 1790 - DNA, 20 bp, Artificial sequence
  Synthetic oligonucleotide
tgacctgtgactatctagga

SEQ ID NO: 1791 - DNA, 20 bp, Artificial sequence
  Synthetic oligonucleotide
gccatttatctgtgctttag

SEQ ID NO: 1792 - DNA, 20 bp, Artificial sequence
  Synthetic oligonucleotide
aaaggctgttaaacatgtgg

SEQ ID NO: 1793 - DNA, 20 bp, Artificial sequence
  Synthetic oligonucleotide
gcctacttctctaggtggga

SEQ ID NO: 1794 - DNA, 20 bp, Artificial sequence
  Synthetic oligonucleotide
acggtattgaaatcaggaga

SEQ ID NO: 1795 - DNA, 20 bp, Artificial sequence
  Synthetic oligonucleotide
tggctgctctgtcttctggc

SEQ ID NO: 1796 - DNA, 20 bp, Artificial sequence
  Synthetic oligonucleotide
ccctccccatcatgagtatg

SEQ ID NO: 1797 - DNA, 20 bp, Artificial sequence
  Synthetic oligonucleotide
gaggaggcctctcatggact

SEQ ID NO: 1798 - DNA, 20 bp, Artificial sequence
  Synthetic oligonucleotide
acggaattacattcagtttc

SEQ ID NO: 1799 - DNA, 20 bp, Artificial sequence
  Synthetic oligonucleotide
attaggatcccatctagtgg

SEQ ID NO: 1800 - DNA, 20 bp, Artificial sequence
  Synthetic oligonucleotide
aagctactaactttaattct

SEQ ID NO: 1801 - DNA, 20 bp, Artificial sequence
  Synthetic oligonucleotide
gaaatggaaagccctcccca

SEQ ID NO: 1802 - DNA, 20 bp, Artificial sequence
  Synthetic oligonucleotide
gtggtaagctgctggagtaa

SEQ ID NO: 1803 - DNA, 20 bp, Artificial sequence
  Synthetic oligonucleotide
cgacttcccaggtcttactt

SEQ ID NO: 1804 - DNA, 20 bp, Artificial sequence
  Synthetic oligonucleotide
gctctggctctgctcgctcc

SEQ ID NO: 1805 - DNA, 20 bp, Artificial sequence
  Synthetic oligonucleotide
ggttcagctcagcagccagc

SEQ ID NO: 1806 - DNA, 20 bp, Artificial sequence
  Synthetic oligonucleotide
tctataggcagccaggttgt

SEQ ID NO: 1807 - DNA, 20 bp, Artificial sequence
  Synthetic oligonucleotide
ggatctctttcagggctgcg

SEQ ID NO: 1808 - DNA, 20 bp, Artificial sequence
  Synthetic oligonucleotide
gaatggtgatccggttctcc

SEQ ID NO: 1809 - DNA, 20 bp, Artificial sequence
  Synthetic oligonucleotide
tgcctcacatcacatccttg

SEQ ID NO: 1810 - DNA, 20 bp, Artificial sequence
  Synthetic oligonucleotide
caggcctgatactgacggag

SEQ ID NO: 1811 - DNA, 20 bp, Artificial sequence
  Synthetic oligonucleotide
agtaggtgccccccgccctc

SEQ ID NO: 1812 - DNA, 20 bp, Artificial sequence
  Synthetic oligonucleotide
ttcccagatactccgagaga

SEQ ID NO: 1813 - DNA, 20 bp, Artificial sequence
  Synthetic oligonucleotide
accaaaagacaaaacaagcc

SEQ ID NO: 1814 - DNA, 20 bp, Artificial sequence
  Synthetic oligonucleotide
gcatagggatatcccacctc

SEQ ID NO: 1815 - DNA, 20 bp, Artificial sequence
  Synthetic oligonucleotide
tgagtcatcgctcaggaggt

SEQ ID NO: 1816 - DNA, 20 bp, Artificial sequence
  Synthetic oligonucleotide
tcctcctccatctctaccag

SEQ ID NO: 1817 - DNA, 20 bp, Artificial sequence
  Synthetic oligonucleotide
caagaggatgagtcacttcc

SEQ ID NO: 1818 - DNA, 20 bp, Artificial sequence
  Synthetic oligonucleotide
agtcatgccctgcccccatg

SEQ ID NO: 1819 - DNA, 20 bp, Artificial sequence
  Synthetic oligonucleotide
agcaaggaagaggcctttag

SEQ ID NO: 1820 - DNA, 20 bp, Artificial sequence
  Synthetic oligonucleotide
tgtgtgtgagtaagaaggga

SEQ ID NO: 1821 - DNA, 20 bp, Artificial sequence
  Synthetic oligonucleotide
ctcagttttacaattgtaaa

SEQ ID NO: 1822 - DNA, 20 bp, Artificial sequence
  Synthetic oligonucleotide
gggagaggagaaccctgaag

SEQ ID NO: 1823 - DNA, 20 bp, Artificial sequence
  Synthetic oligonucleotide
ctggtgagcctgtattggta

SEQ ID NO: 1824 - DNA, 20 bp, Artificial sequence
  Synthetic oligonucleotide
aaaatgacgcagtccaggcc

SEQ ID NO: 1825 - DNA, 20 bp, Artificial sequence
  Synthetic oligonucleotide
taacaagctctgccagttta

SEQ ID NO: 1826 - DNA, 20 bp, Artificial sequence
  Synthetic oligonucleotide
gaactgagtcagcactgagc

SEQ ID NO: 1827 - DNA, 20 bp, Artificial sequence
  Synthetic oligonucleotide
tattcactgcaagagctgcg

SEQ ID NO: 1828 - DNA, 20 bp, Artificial sequence
  Synthetic oligonucleotide
atatttaacattaagagcag

SEQ ID NO: 1829 - DNA, 20 bp, Artificial sequence
  Synthetic oligonucleotide
cctggtatgataggctctgg

SEQ ID NO: 1830 - DNA, 20 bp, Artificial sequence
  Synthetic oligonucleotide
atctgcagacagggcagatg

SEQ ID NO: 1831 - DNA, 20 bp, Artificial sequence
  Synthetic oligonucleotide
agccccttctgctcacaagg

SEQ ID NO: 1832 - DNA, 20 bp, Artificial sequence
  Synthetic oligonucleotide
cctggcagaaggcatgcggg

SEQ ID NO: 1833 - DNA, 20 bp, Artificial sequence
  Synthetic oligonucleotide
caggctcagaataggtgagc

SEQ ID NO: 1834 - DNA, 20 bp, Artificial sequence
  Synthetic oligonucleotide
cctgtgctttgcgcccagac

SEQ ID NO: 1835 - DNA, 20 bp, Artificial sequence
  Synthetic oligonucleotide
ccaccttttgaaatgaattt

SEQ ID NO: 1836 - DNA, 20 bp, Artificial sequence
  Synthetic oligonucleotide
atccacaagcatacactcac

SEQ ID NO: 1837 - DNA, 20 bp, Artificial sequence
  Synthetic oligonucleotide
tgaatacctgcctcagtctc

SEQ ID NO: 1838 - DNA, 20 bp, Artificial sequence
  Synthetic oligonucleotide
cccattcctcagccttgcct

SEQ ID NO: 1839 - DNA, 20 bp, Artificial sequence
  Synthetic oligonucleotide
tgagtgtctctctcagtctc

SEQ ID NO: 1840 - DNA, 20 bp, Artificial sequence
  Synthetic oligonucleotide
ccttagtgtctttctgtttg

SEQ ID NO: 1841 - DNA, 20 bp, Artificial sequence
  Synthetic oligonucleotide
cgccattgtgtcctcttctg

SEQ ID NO: 1842 - DNA, 20 bp, Artificial sequence
  Synthetic oligonucleotide
cattctcttgtacagagcaa

SEQ ID NO: 1843 - DNA, 20 bp, Artificial sequence
  Synthetic oligonucleotide
cctgggcaagccatctcact

SEQ ID NO: 1844 - DNA, 20 bp, Artificial sequence
  Synthetic oligonucleotide
aacagtatcagctactacta

SEQ ID NO: 1845 - DNA, 20 bp, Artificial sequence
  Synthetic oligonucleotide
taaggtaatccatgaaaagc

SEQ ID NO: 1846 - DNA, 20 bp, Artificial sequence
  Synthetic oligonucleotide
cccaagtgagatgtgctaga

SEQ ID NO: 1847 - DNA, 20 bp, Artificial sequence
  Synthetic oligonucleotide
tccaggtcagacacctctct

SEQ ID NO: 1848 - DNA, 20 bp, Artificial sequence
  Synthetic oligonucleotide
taagctctgagctgtggtgt

SEQ ID NO: 1849 - DNA, 20 bp, Artificial sequence
  Synthetic oligonucleotide
gcccaaatgccccctctaca

SEQ ID NO: 1850 - DNA, 20 bp, Artificial sequence
  Synthetic oligonucleotide
gccctgcctctctgtgcttt

SEQ ID NO: 1851 - DNA, 20 bp, Artificial sequence
  Synthetic oligonucleotide
cagggaggtcctcccagccc

SEQ ID NO: 1852 - DNA, 20 bp, Artificial sequence
  Synthetic oligonucleotide
ttccacactgacagctgcat

SEQ ID NO: 1853 - DNA, 20 bp, Artificial sequence
  Synthetic oligonucleotide
tggctgggacttttcccaac

SEQ ID NO: 1854 - DNA, 20 bp, Artificial sequence
  Synthetic oligonucleotide
cctgccctggccgcgctcac

SEQ ID NO: 1855 - DNA, 20 bp, Artificial sequence
  Synthetic oligonucleotide
cgttcaggccccgccctcga

SEQ ID NO: 1856 - DNA, 20 bp, Artificial sequence
  Synthetic oligonucleotide
aagggagcaagatgagctct

SEQ ID NO: 1857 - DNA, 20 bp, Artificial sequence
  Synthetic oligonucleotide
ctaatcaatattggttgaat

SEQ ID NO: 1858 - DNA, 20 bp, Artificial sequence
  Synthetic oligonucleotide
aggtgaggagtccaatcttg

SEQ ID NO: 1859 - DNA, 20 bp, Artificial sequence
  Synthetic oligonucleotide
gaaagtggtgaagaaagttc

SEQ ID NO: 1860 - DNA, 20 bp, Artificial sequence
  Synthetic oligonucleotide
ccatcatgacaacttgaacg

SEQ ID NO: 1861 - DNA, 20 bp, Artificial sequence
  Synthetic oligonucleotide
aatttagctcccccctcccc

SEQ ID NO: 1862 - DNA, 20 bp, Artificial sequence
  Synthetic oligonucleotide
ttagctaagaatcatttcag

SEQ ID NO: 1863 - DNA, 20 bp, Artificial sequence
  Synthetic oligonucleotide
cctaaatattctagtccaga

SEQ ID NO: 1864 - DNA, 20 bp, Artificial sequence
  Synthetic oligonucleotide
cctggttagcctttctgatg

SEQ ID NO: 1865 - DNA, 20 bp, Artificial sequence
  Synthetic oligonucleotide
ttggcagtattacctctact

SEQ ID NO: 1866 - DNA, 20 bp, Artificial sequence
  Synthetic oligonucleotide
tagtgacctgtgactatcta

SEQ ID NO: 1867 - DNA, 20 bp, Artificial sequence
  Synthetic oligonucleotide
ctgccatttatctgtgcttt

SEQ ID NO: 1868 - DNA, 20 bp, Artificial sequence
  Synthetic oligonucleotide
actaaaataaaggctgttaa

SEQ ID NO: 1869 - DNA, 20 bp, Artificial sequence
  Synthetic oligonucleotide
aaccagccacatgactctgg

SEQ ID NO: 1870 - DNA, 20 bp, Artificial sequence
  Synthetic oligonucleotide
gcacggtattgaaatcagga

SEQ ID NO: 1871 - DNA, 20 bp, Artificial sequence
  Synthetic oligonucleotide
gctgctgccagagtcctggc

SEQ ID NO: 1872 - DNA, 20 bp, Artificial sequence
  Synthetic oligonucleotide
ccccatcgcacccccctccc

SEQ ID NO: 1873 - DNA, 20 bp, Artificial sequence
  Synthetic oligonucleotide
caggctggtttctgcagatg

SEQ ID NO: 1874 - DNA, 20 bp, Artificial sequence
  Synthetic oligonucleotide
aaacggaattacattcagtt

SEQ ID NO: 1875 - DNA, 20 bp, Artificial sequence
  Synthetic oligonucleotide
gtattaggatcccatctagt

SEQ ID NO: 1876 - DNA, 20 bp, Artificial sequence
  Synthetic oligonucleotide
gaaagctactaactttaatt

SEQ ID NO: 1877 - DNA, 20 bp, Artificial sequence
  Synthetic oligonucleotide
ccctggtagtttccttttac

SEQ ID NO: 1878 - DNA, 20 bp, Artificial sequence
  Synthetic oligonucleotide
cgagtggtaagctgctggag

SEQ ID NO: 1879 - DNA, 20 bp, Artificial sequence
  Synthetic oligonucleotide
ccttgggaagtccccgactt

SEQ ID NO: 1880 - DNA, 20 bp, Artificial sequence
  Synthetic oligonucleotide
atcatctcccctgaggagac

SEQ ID NO: 1881 - DNA, 20 bp, Artificial sequence
  Synthetic oligonucleotide
gtgggctccttggcccgcag

SEQ ID NO: 1882 - DNA, 20 bp, Artificial sequence
  Synthetic oligonucleotide
ctgcttcctgtctataggca

SEQ ID NO: 1883 - DNA, 20 bp, Artificial sequence
  Synthetic oligonucleotide
cggatctctttcagggctgc

SEQ ID NO: 1884 - DNA, 20 bp, Artificial sequence
  Synthetic oligonucleotide
ggagaaggtctgcacgggaa

SEQ ID NO: 1885 - DNA, 20 bp, Artificial sequence
  Synthetic oligonucleotide
ggtcctgcctcacatcacat

SEQ ID NO: 1886 - DNA, 20 bp, Artificial sequence
  Synthetic oligonucleotide
ctggcaggcctgatactgac

SEQ ID NO: 1887 - DNA, 20 bp, Artificial sequence
  Synthetic oligonucleotide
gggcgatgtagtaggtgccc

SEQ ID NO: 1888 - DNA, 20 bp, Artificial sequence
  Synthetic oligonucleotide
tcaaaggcacagttcccaga

SEQ ID NO: 1889 - DNA, 20 bp, Artificial sequence
  Synthetic oligonucleotide
aaccaaaagacaaaacaagc

SEQ ID NO: 1890 - DNA, 20 bp, Artificial sequence
  Synthetic oligonucleotide
cagcatagggatatcccacc

SEQ ID NO: 1891 - DNA, 20 bp, Artificial sequence
  Synthetic oligonucleotide
ttgagtcatcgctcaggagg

SEQ ID NO: 1892 - DNA, 20 bp, Artificial sequence
  Synthetic oligonucleotide
ctcctcctccatctctacca

SEQ ID NO: 1893 - DNA, 20 bp, Artificial sequence
  Synthetic oligonucleotide
atcttcaagaggatgagtca

SEQ ID NO: 1894 - DNA, 20 bp, Artificial sequence
  Synthetic oligonucleotide
aaagtcatgccctgccccca

SEQ ID NO: 1895 - DNA, 20 bp, Artificial sequence
  Synthetic oligonucleotide
ggtatgacacagcaaggaag

SEQ ID NO: 1896 - DNA, 20 bp, Artificial sequence
  Synthetic oligonucleotide
ttgtgtgtgagtaagaaggg

SEQ ID NO: 1897 - DNA, 20 bp, Artificial sequence
  Synthetic oligonucleotide
cgtgcctcagttttacaatt

SEQ ID NO: 1898 - DNA, 20 bp, Artificial sequence
  Synthetic oligonucleotide
tggagggaaaggacaccaag

SEQ ID NO: 1899 - DNA, 20 bp, Artificial sequence
  Synthetic oligonucleotide
tctttggtgcttttgccccc

SEQ ID NO: 1900 - DNA, 20 bp, Artificial sequence
  Synthetic oligonucleotide
tctggtgagcctgtattggt

SEQ ID NO: 1901 - DNA, 20 bp, Artificial sequence
  Synthetic oligonucleotide
gggaaaatgacgcagtccag

SEQ ID NO: 1902 - DNA, 20 bp, Artificial sequence
  Synthetic oligonucleotide
gcgcacccaaggactcacca

SEQ ID NO: 1903 - DNA, 20 bp, Artificial sequence
  Synthetic oligonucleotide
ctgaactgagtcagcactga

SEQ ID NO: 1904 - DNA, 20 bp, Artificial sequence
  Synthetic oligonucleotide
aaactttattcactgcaaga

SEQ ID NO: 1905 - DNA, 20 bp, Artificial sequence
  Synthetic oligonucleotide
gtaccctggtatgataggct

SEQ ID NO: 1906 - DNA, 20 bp, Artificial sequence
  Synthetic oligonucleotide
acactcagaagggcagtgct

SEQ ID NO: 1907 - DNA, 20 bp, Artificial sequence
  Synthetic oligonucleotide
cagccccttctgctcacaag

SEQ ID NO: 1908 - DNA, 20 bp, Artificial sequence
  Synthetic oligonucleotide
ccctggactcctggcagaag

SEQ ID NO: 1909 - DNA, 20 bp, Artificial sequence
  Synthetic oligonucleotide
catcaaccttctccgcttcc

SEQ ID NO: 1910 - DNA, 20 bp, Artificial sequence
  Synthetic oligonucleotide
acctgtgctttgcgcccaga

SEQ ID NO: 1911 - DNA, 20 bp, Artificial sequence
  Synthetic oligonucleotide
tgcatgtcctgtcagctcag

SEQ ID NO: 1912 - DNA, 20 bp, Artificial sequence
  Synthetic oligonucleotide
gcgcatccacaagcatacac

SEQ ID NO: 1913 - DNA, 20 bp, Artificial sequence
  Synthetic oligonucleotide
ttgaatacctgcctcagtct

SEQ ID NO: 1914 - DNA, 20 bp, Artificial sequence
  Synthetic oligonucleotide
tgaggagtagagggccactg

SEQ ID NO: 1915 - DNA, 20 bp, Artificial sequence
  Synthetic oligonucleotide
tctgagtgtctctctcagtc

SEQ ID NO: 1916 - DNA, 20 bp, Artificial sequence
  Synthetic oligonucleotide
tcccttagtgtctttctgtt

SEQ ID NO: 1917 - DNA, 20 bp, Artificial sequence
  Synthetic oligonucleotide
ccccacgccattgtgtcctc

SEQ ID NO: 1918 - DNA, 20 bp, Artificial sequence
  Synthetic oligonucleotide
cccattctcttgtacagagc

SEQ ID NO: 1919 - DNA, 20 bp, Artificial sequence
  Synthetic oligonucleotide
ccctgggcaagccatctcac

SEQ ID NO: 1920 - DNA, 20 bp, Artificial sequence
  Synthetic oligonucleotide
aacagaacagtatcagctac

SEQ ID NO: 1921 - DNA, 20 bp, Artificial sequence
  Synthetic oligonucleotide
gtaaggtaatccatgaaaag

SEQ ID NO: 1922 - DNA, 20 bp, Artificial sequence
  Synthetic oligonucleotide
ggctcccaagtgagatgtgc

SEQ ID NO: 1923 - DNA, 20 bp, Artificial sequence
  Synthetic oligonucleotide
cttccaggtcagacacctct

SEQ ID NO: 1924 - DNA, 20 bp, Artificial sequence
  Synthetic oligonucleotide
ataagctctgagctgtggtg

SEQ ID NO: 1925 - DNA, 20 bp, Artificial sequence
  Synthetic oligonucleotide
agcccaaatgccccctctac

SEQ ID NO: 1926 - DNA, 20 bp, Artificial sequence
  Synthetic oligonucleotide
cagctaggtgccctggctag

SEQ ID NO: 1927 - DNA, 20 bp, Artificial sequence
  Synthetic oligonucleotide
ccctgcctgcagggaggtcc

SEQ ID NO: 1928 - DNA, 20 bp, Artificial sequence
  Synthetic oligonucleotide
cagtgccacagaatccagaa

SEQ ID NO: 1929 - DNA, 20 bp, Artificial sequence
  Synthetic oligonucleotide
ccccagttaaccccaggacg

SEQ ID NO: 1930 - DNA, 20 bp, Artificial sequence
  Synthetic oligonucleotide
tccccgtcctgccctggccg

SEQ ID NO: 1931 - DNA, 20 bp, Artificial sequence
  Synthetic oligonucleotide
gccccaggccccgcctctag

SEQ ID NO: 1932 - DNA, 20 bp, Artificial sequence
  Synthetic oligonucleotide
cagtccctgaagggagcaag

SEQ ID NO: 1933 - DNA, 20 bp, Artificial sequence
  Synthetic oligonucleotide
gcctaatcaatattggttga

SEQ ID NO: 1934 - DNA, 20 bp, Artificial sequence
  Synthetic oligonucleotide
tgaggtgaggagtccaatct

SEQ ID NO: 1935 - DNA, 20 bp, Artificial sequence
  Synthetic oligonucleotide
ctgaaggaagatggaaaagg

SEQ ID NO: 1936 - DNA, 20 bp, Artificial sequence
  Synthetic oligonucleotide
ggccatcatgacaacttgaa

SEQ ID NO: 1937 - DNA, 20 bp, Artificial sequence
  Synthetic oligonucleotide
taatttagctcccccctccc

SEQ ID NO: 1938 - DNA, 20 bp, Artificial sequence
  Synthetic oligonucleotide
cttagctaagaatcatttca

SEQ ID NO: 1939 - DNA, 20 bp, Artificial sequence
  Synthetic oligonucleotide
tcctaaatattctagtccag

SEQ ID NO: 1940 - DNA, 20 bp, Artificial sequence
  Synthetic oligonucleotide
agcctggttagcctttctga

SEQ ID NO: 1941 - DNA, 20 bp, Artificial sequence
  Synthetic oligonucleotide
tttggcagtattacctctac

SEQ ID NO: 1942 - DNA, 20 bp, Artificial sequence
  Synthetic oligonucleotide
ttagtgacctgtgactatct

SEQ ID NO: 1943 - DNA, 20 bp, Artificial sequence
  Synthetic oligonucleotide
ctctgccatttatctgtgct

SEQ ID NO: 1944 - DNA, 20 bp, Artificial sequence
  Synthetic oligonucleotide
ttaactaaaataaaggctgt

SEQ ID NO: 1945 - DNA, 20 bp, Artificial sequence
  Synthetic oligonucleotide
tcaagaagtcccaacttagc

SEQ ID NO: 1946 - DNA, 20 bp, Artificial sequence
  Synthetic oligonucleotide
agcacggtattgaaatcagg

SEQ ID NO: 1947 - DNA, 20 bp, Artificial sequence
  Synthetic oligonucleotide
tgctgctgccagagtcctgg

SEQ ID NO: 1948 - DNA, 20 bp, Artificial sequence
  Synthetic oligonucleotide
catgcccggcttccccatcg

SEQ ID NO: 1949 - DNA, 20 bp, Artificial sequence
  Synthetic oligonucleotide
cttacctctccatcccgcat

SEQ ID NO: 1950 - DNA, 20 bp, Artificial sequence
  Synthetic oligonucleotide
gaggaaacggaattacattc

SEQ ID NO: 1951 - DNA, 20 bp, Artificial sequence
  Synthetic oligonucleotide
tgtattaggatcccatctag

SEQ ID NO: 1952 - DNA, 20 bp, Artificial sequence
  Synthetic oligonucleotide
tgaaagctactaactttaat

SEQ ID NO: 1953 - DNA, 20 bp, Artificial sequence
  Synthetic oligonucleotide
attcccctggtagtttcctt

SEQ ID NO: 1954 - DNA, 20 bp, Artificial sequence
  Synthetic oligonucleotide
gcgagtggtaagctgctgga

SEQ ID NO: 1955 - DNA, 20 bp, Artificial sequence
  Synthetic oligonucleotide
aggctgtgtaaccttgggaa

SEQ ID NO: 1956 - DNA, 20 bp, Artificial sequence
  Synthetic oligonucleotide
catcatctcccctgaggaga

SEQ ID NO: 1957 - DNA, 20 bp, Artificial sequence
  Synthetic oligonucleotide
cttggtgggctccttggccc

SEQ ID NO: 1958 - DNA, 20 bp, Artificial sequence
  Synthetic oligonucleotide
tctgcttcctgtctataggc

SEQ ID NO: 1959 - DNA, 20 bp, Artificial sequence
  Synthetic oligonucleotide
gcggatctctttcagggctg

SEQ ID NO: 1960 - DNA, 20 bp, Artificial sequence
  Synthetic oligonucleotide
ttctcgaatctgcaggttgg

SEQ ID NO: 1961 - DNA, 20 bp, Artificial sequence
  Synthetic oligonucleotide
caggtgggtcctgcctcaca

SEQ ID NO: 1962 - DNA, 20 bp, Artificial sequence
  Synthetic oligonucleotide
tctggcaggcctgatactga

SEQ ID NO: 1963 - DNA, 20 bp, Artificial sequence
  Synthetic oligonucleotide
gagggcgatgtagtaggtgc

SEQ ID NO: 1964 - DNA, 20 bp, Artificial sequence
  Synthetic oligonucleotide
ggaaactcaaaggcacagtt

SEQ ID NO: 1965 - DNA, 20 bp, Artificial sequence
  Synthetic oligonucleotide
ctcataaaaaccaaaagaca

SEQ ID NO: 1966 - DNA, 20 bp, Artificial sequence
  Synthetic oligonucleotide
gcagcatagggatatcccac

SEQ ID NO: 1967 - DNA, 20 bp, Artificial sequence
  Synthetic oligonucleotide
ctgagacacttgagtcatcg

SEQ ID NO: 1968 - DNA, 20 bp, Artificial sequence
  Synthetic oligonucleotide
gcctcctcctccatctctac

SEQ ID NO: 1969 - DNA, 20 bp, Artificial sequence
  Synthetic oligonucleotide
cagcatcttcaagaggatga

SEQ ID NO: 1970 - DNA, 20 bp, Artificial sequence
  Synthetic oligonucleotide
caaagtcatgccctgccccc

SEQ ID NO: 1971 - DNA, 20 bp, Artificial sequence
  Synthetic oligonucleotide
tggtatgacacagcaaggaa

SEQ ID NO: 1972 - DNA, 20 bp, Artificial sequence
  Synthetic oligonucleotide
ttttgtgtgtgagtaagaag

SEQ ID NO: 1973 - DNA, 20 bp, Artificial sequence
  Synthetic oligonucleotide
gccagtgtcttcactttgct

SEQ ID NO: 1974 - DNA, 20 bp, Artificial sequence
  Synthetic oligonucleotide
cagtgccctgaagattagca

SEQ ID NO: 1975 - DNA, 20 bp, Artificial sequence
  Synthetic oligonucleotide
gtctttggtgcttttgcccc

SEQ ID NO: 1976 - DNA, 20 bp, Artificial sequence
  Synthetic oligonucleotide
atctggtgagcctgtattgg

SEQ ID NO: 1977 - DNA, 20 bp, Artificial sequence
  Synthetic oligonucleotide
tgggaaaatgacgcagtcca

SEQ ID NO: 1978 - DNA, 20 bp, Artificial sequence
  Synthetic oligonucleotide
cagagcagctccactgcgca

SEQ ID NO: 1979 - DNA, 20 bp, Artificial sequence
  Synthetic oligonucleotide
tctgaactgagtcagcactg

SEQ ID NO: 1980 - DNA, 20 bp, Artificial sequence
  Synthetic oligonucleotide
aaaactttattcactgcaag

SEQ ID NO: 1981 - DNA, 20 bp, Artificial sequence
  Synthetic oligonucleotide
acctcgaatctgcaggttgg

SEQ ID NO: 1982 - DNA, 20 bp, Artificial sequence
  Synthetic oligonucleotide
agtaccctggtatgataggc

SEQ ID NO: 1983 - DNA, 20 bp, Artificial sequence
  Synthetic oligonucleotide
gacaagcagttaaaaaaaca

SEQ ID NO: 1984 - DNA, 20 bp, Artificial sequence
  Synthetic oligonucleotide
tcagccccttctgctcacaa

SEQ ID NO: 1985 - DNA, 20 bp, Artificial sequence
  Synthetic oligonucleotide
ctttccccagtagggaggtg

SEQ ID NO: 1986 - DNA, 20 bp, Artificial sequence
  Synthetic oligonucleotide
tcatggacatcaaccttctc

SEQ ID NO: 1987 - DNA, 20 bp, Artificial sequence
  Synthetic oligonucleotide
gtcacctgtgctttgcgccc

SEQ ID NO: 1988 - DNA, 20 bp, Artificial sequence
  Synthetic oligonucleotide
catgcatgtcctgtcagctc

SEQ ID NO: 1989 - DNA, 20 bp, Artificial sequence
  Synthetic oligonucleotide
ggcgcatccacaagcataca

SEQ ID NO: 1990 - DNA, 20 bp, Artificial sequence
  Synthetic oligonucleotide
tgaggacacttgaatacctg

SEQ ID NO: 1991 - DNA, 20 bp, Artificial sequence
  Synthetic oligonucleotide
gcttcctggagtggcaggag

SEQ ID NO: 1992 - DNA, 20 bp, Artificial sequence
  Synthetic oligonucleotide
tctcctctctctgagtgtct

SEQ ID NO: 1993 - DNA, 20 bp, Artificial sequence
  Synthetic oligonucleotide
tctcccttagtgtctttctg

SEQ ID NO: 1994 - DNA, 20 bp, Artificial sequence
  Synthetic oligonucleotide
gggttccccacgccattgtg

SEQ ID NO: 1995 - DNA, 20 bp, Artificial sequence
  Synthetic oligonucleotide
cccccattctcttgtacaga

SEQ ID NO: 1996 - DNA, 20 bp, Artificial sequence
  Synthetic oligonucleotide
agcaatagtgcctgtgtgac

SEQ ID NO: 1997 - DNA, 20 bp, Artificial sequence
  Synthetic oligonucleotide
gaacagaacagtatcagcta

SEQ ID NO: 1998 - DNA, 20 bp, Artificial sequence
  Synthetic oligonucleotide
agtaaggtaatccatgaaaa

SEQ ID NO: 1999 - DNA, 20 bp, Artificial sequence
  Synthetic oligonucleotide
aggctcccaagtgagatgtg

SEQ ID NO: 2000 - DNA, 20 bp, Artificial sequence
  Synthetic oligonucleotide
atcacaccttccaggtcaga

SEQ ID NO: 2001 - DNA, 20 bp, Artificial sequence
  Synthetic oligonucleotide
atataagctctgagctgtgg

SEQ ID NO: 2002 - DNA, 20 bp, Artificial sequence
  Synthetic oligonucleotide
tagcccaaatgccccctcta

SEQ ID NO: 2003 - DNA, 20 bp, Artificial sequence
  Synthetic oligonucleotide
ctcctcagctaggtgccctg

SEQ ID NO: 2004 - DNA, 20 bp, Artificial sequence
  Synthetic oligonucleotide
ctcccctgcctgcagggagg

SEQ ID NO: 2005 - DNA, 20 bp, Artificial sequence
  Synthetic oligonucleotide
atgaacagtgccacagaatc

SEQ ID NO: 2006 - DNA, 20 bp, Artificial sequence
  Synthetic oligonucleotide
accccagttaaccccaggac

SEQ ID NO: 2007 - DNA, 20 bp, Artificial sequence
  Synthetic oligonucleotide
cgtccccgtcctgccctggc

SEQ ID NO: 2008 - DNA, 20 bp, Artificial sequence
  Synthetic oligonucleotide
tttcgaggcccggcccccgg

SEQ ID NO: 2009 - DNA, 20 bp, Artificial sequence
  Synthetic oligonucleotide
agactcagtccctgaaggga

SEQ ID NO: 2010 - DNA, 20 bp, Artificial sequence
  Synthetic oligonucleotide
ggcctaatcaatattggttg

SEQ ID NO: 2011 - DNA, 20 bp, Artificial sequence
  Synthetic oligonucleotide
ggtgaggtgaggagtccaat

SEQ ID NO: 2012 - DNA, 20 bp, Artificial sequence
  Synthetic oligonucleotide
catgtctatctgaaggaaga

SEQ ID NO: 2013 - DNA, 20 bp, Artificial sequence
  Synthetic oligonucleotide
ggacacccctaggctgggtc

SEQ ID NO: 2014 - DNA, 20 bp, Artificial sequence
  Synthetic oligonucleotide
aaaaagtaatttagctcccc

SEQ ID NO: 2015 - DNA, 20 bp, Artificial sequence
  Synthetic oligonucleotide
ccttagctaagaatcatttc

SEQ ID NO: 2016 - DNA, 20 bp, Artificial sequence
  Synthetic oligonucleotide
gtcctaaatattctagtcca

SEQ ID NO: 2017 - DNA, 20 bp, Artificial sequence
  Synthetic oligonucleotide
cagcctggttagcctttctg

SEQ ID NO: 2018 - DNA, 20 bp, Artificial sequence
  Synthetic oligonucleotide
atttggcagtattacctcta

SEQ ID NO: 2019 - DNA, 20 bp, Artificial sequence
  Synthetic oligonucleotide
tttagtgacctgtgactatc

SEQ ID NO: 2020 - DNA, 20 bp, Artificial sequence
  Synthetic oligonucleotide
tctctgccatttatctgtgc

SEQ ID NO: 2021 - DNA, 20 bp, Artificial sequence
  Synthetic oligonucleotide
attaactaaaataaaggctg

SEQ ID NO: 2022 - DNA, 20 bp, Artificial sequence
  Synthetic oligonucleotide
ctcaagaagtcccaacttag

SEQ ID NO: 2023 - DNA, 20 bp, Artificial sequence
  Synthetic oligonucleotide
ccagcacggtattgaaatca

SEQ ID NO: 2024 - DNA, 20 bp, Artificial sequence
  Synthetic oligonucleotide
tagtgctgctgccagagtcc

SEQ ID NO: 2025 - DNA, 20 bp, Artificial sequence
  Synthetic oligonucleotide
ctcccatgcccggcttcccc

SEQ ID NO: 2026 - DNA, 20 bp, Artificial sequence
  Synthetic oligonucleotide
tggcctggccttgagaatcc

SEQ ID NO: 2027 - DNA, 20 bp, Artificial sequence
  Synthetic oligonucleotide
tatggagggactgaggaaac

SEQ ID NO: 2028 - DNA, 20 bp, Artificial sequence
  Synthetic oligonucleotide
gtgtattaggatcccatcta

SEQ ID NO: 2029 - DNA, 20 bp, Artificial sequence
  Synthetic oligonucleotide
gtgaaagctactaactttaa

SEQ ID NO: 2030 - DNA, 20 bp, Artificial sequence
  Synthetic oligonucleotide
atcccctcttcccattcccc

SEQ ID NO: 2031 - DNA, 20 bp, Artificial sequence
  Synthetic oligonucleotide
ggcgagtggtaagctgctgg

SEQ ID NO: 2032 - DNA, 20 bp, Artificial sequence
  Synthetic oligonucleotide
cgaggctgtgtaaccttggg

SEQ ID NO: 2033 - DNA, 20 bp, Artificial sequence
  Synthetic oligonucleotide
cccagacggcggccaggagc

SEQ ID NO: 2034 - DNA, 20 bp, Artificial sequence
  Synthetic oligonucleotide
gcagctcagcctggtagacg

SEQ ID NO: 2035 - DNA, 20 bp, Artificial sequence
  Synthetic oligonucleotide
cttcatctgcttcctgtcta

SEQ ID NO: 2036 - DNA, 20 bp, Artificial sequence
  Synthetic oligonucleotide
aacttggagcggtaccactc

SEQ ID NO: 2037 - DNA, 20 bp, Artificial sequence
  Synthetic oligonucleotide
tctgacacagacttggtgtc

SEQ ID NO: 2038 - DNA, 20 bp, Artificial sequence
  Synthetic oligonucleotide
ctgctcgggcccctcatgag

SEQ ID NO: 2039 - DNA, 20 bp, Artificial sequence
  Synthetic oligonucleotide
gtctggcaggcctgatactg

SEQ ID NO: 2040 - DNA, 20 bp, Artificial sequence
  Synthetic oligonucleotide
ggagggcgatgtagtaggtg

SEQ ID NO: 2041 - DNA, 20 bp, Artificial sequence
  Synthetic oligonucleotide
ctgagtctcagttttcctcc

SEQ ID NO: 2042 - DNA, 20 bp, Artificial sequence
  Synthetic oligonucleotide
cctcataaaaaccaaaagac

SEQ ID NO: 2043 - DNA, 20 bp, Artificial sequence
  Synthetic oligonucleotide
ggcagcatagggatatccca

SEQ ID NO: 2044 - DNA, 20 bp, Artificial sequence
  Synthetic oligonucleotide
actgagacacttgagtcatc

SEQ ID NO: 2045 - DNA, 20 bp, Artificial sequence
  Synthetic oligonucleotide
caattgcctcctcctccatc

SEQ ID NO: 2046 - DNA, 20 bp, Artificial sequence
  Synthetic oligonucleotide
gtttcagcatcttcaagagg

SEQ ID NO: 2047 - DNA, 20 bp, Artificial sequence
  Synthetic oligonucleotide
acaaagtcatgccctgcccc

SEQ ID NO: 2048 - DNA, 20 bp, Artificial sequence
  Synthetic oligonucleotide
ctggtatgacacagcaagga

SEQ ID NO: 2049 - DNA, 20 bp, Artificial sequence
  Synthetic oligonucleotide
attttgtgtgtgagtaagaa

SEQ ID NO: 2050 - DNA, 20 bp, Artificial sequence
  Synthetic oligonucleotide
gagccagtgtcttcactttg

SEQ ID NO: 2051 - DNA, 20 bp, Artificial sequence
  Synthetic oligonucleotide
gcagtgccctgaagattagc

SEQ ID NO: 2052 - DNA, 20 bp, Artificial sequence
  Synthetic oligonucleotide
tccccgtctttggtgctttt

SEQ ID NO: 2053 - DNA, 20 bp, Artificial sequence
  Synthetic oligonucleotide
catttacaatctggtgagcc

SEQ ID NO: 2054 - DNA, 20 bp, Artificial sequence
  Synthetic oligonucleotide
cctgggaaaatgacgcagtc

SEQ ID NO: 2055 - DNA, 20 bp, Artificial sequence
  Synthetic oligonucleotide
gctcagaggccccagagcag

SEQ ID NO: 2056 - DNA, 20 bp, Artificial sequence
  Synthetic oligonucleotide
ctctgaactgagtcagcact

SEQ ID NO: 2057 - DNA, 20 bp, Artificial sequence
  Synthetic oligonucleotide
ataaaactttattcactgca

SEQ ID NO: 2058 - DNA, 20 bp, Artificial sequence
  Synthetic oligonucleotide
gcccttcccacgaggccctg

SEQ ID NO: 2059 - DNA, 20 bp, Artificial sequence
  Synthetic oligonucleotide
gaagtaccctggtatgatag

SEQ ID NO: 2060 - DNA, 20 bp, Artificial sequence
  Synthetic oligonucleotide
tgacaagcagttaaaaaaac

SEQ ID NO: 2061 - DNA, 20 bp, Artificial sequence
  Synthetic oligonucleotide
ttcagccccttctgctcaca

SEQ ID NO: 2062 - DNA, 20 bp, Artificial sequence
  Synthetic oligonucleotide
tgctttccccagtagggagg

SEQ ID NO: 2063 - DNA, 20 bp, Artificial sequence
  Synthetic oligonucleotide
aatctccctcatggacatca

SEQ ID NO: 2064 - DNA, 20 bp, Artificial sequence
  Synthetic oligonucleotide
gcaggcagtcacctgtgctt

SEQ ID NO: 2065 - DNA, 20 bp, Artificial sequence
  Synthetic oligonucleotide
aaggcacacatgcatgtcct

SEQ ID NO: 2066 - DNA, 20 bp, Artificial sequence
  Synthetic oligonucleotide
ctgcttctgctcacacaggc

SEQ ID NO: 2067 - DNA, 20 bp, Artificial sequence
  Synthetic oligonucleotide
ctgaggacacttgaatacct

SEQ ID NO: 2068 - DNA, 20 bp, Artificial sequence
  Synthetic oligonucleotide
ctgcttcctggagtggcagg

SEQ ID NO: 2069 - DNA, 20 bp, Artificial sequence
  Synthetic oligonucleotide
ctctcctctctctgagtgtc

SEQ ID NO: 2070 - DNA, 20 bp, Artificial sequence
  Synthetic oligonucleotide
tctttccgtctcccttagtg

SEQ ID NO: 2071 - DNA, 20 bp, Artificial sequence
  Synthetic oligonucleotide
agggtacaggccacagctgg

SEQ ID NO: 2072 - DNA, 20 bp, Artificial sequence
  Synthetic oligonucleotide
cttcccccattctcttgtac

SEQ ID NO: 2073 - DNA, 20 bp, Artificial sequence
  Synthetic oligonucleotide
aaagcaatagtgcctgtgtg

SEQ ID NO: 2074 - DNA, 20 bp, Artificial sequence
  Synthetic oligonucleotide
agaacagaacagtatcagct

SEQ ID NO: 2075 - DNA, 20 bp, Artificial sequence
  Synthetic oligonucleotide
tagtaaggtaatccatgaaa

SEQ ID NO: 2076 - DNA, 20 bp, Artificial sequence
  Synthetic oligonucleotide
aggcatggaatgcaggctcc

SEQ ID NO: 2077 - DNA, 20 bp, Artificial sequence
  Synthetic oligonucleotide
tatcacaccttccaggtcag

SEQ ID NO: 2078 - DNA, 20 bp, Artificial sequence
  Synthetic oligonucleotide
catataagctctgagctgtg

SEQ ID NO: 2079 - DNA, 20 bp, Artificial sequence
  Synthetic oligonucleotide
ctagcccaaatgccccctct

SEQ ID NO: 2080 - DNA, 20 bp, Artificial sequence
  Synthetic oligonucleotide
cactcctcagctaggtgccc

SEQ ID NO: 2081 - DNA, 20 bp, Artificial sequence
  Synthetic oligonucleotide
tctcccctgcctgcagggag

SEQ ID NO: 2082 - DNA, 20 bp, Artificial sequence
  Synthetic oligonucleotide
gaatgaacagtgccacagaa

SEQ ID NO: 2083 - DNA, 20 bp, Artificial sequence
  Synthetic oligonucleotide
caccccagttaaccccagga

SEQ ID NO: 2084 - DNA, 20 bp, Artificial sequence
  Synthetic oligonucleotide
ccgtccccgtcctgccctgg

SEQ ID NO: 2085 - DNA, 20 bp, Artificial sequence
  Synthetic oligonucleotide
gtttcgaggcccggcccccg

SEQ ID NO: 2086 - DNA, 20 bp, Artificial sequence
  Synthetic oligonucleotide
aaagactcagtccctgaagg

SEQ ID NO: 2087 - DNA, 20 bp, Artificial sequence
  Synthetic oligonucleotide
aggcctaatcaatattggtt

SEQ ID NO: 2088 - DNA, 20 bp, Artificial sequence
  Synthetic oligonucleotide
gggtgaggtgaggagtccaa

SEQ ID NO: 2089 - DNA, 20 bp, Artificial sequence
  Synthetic oligonucleotide
gcatgtctatctgaaggaag

SEQ ID NO: 2090 - DNA, 20 bp, Artificial sequence
  Synthetic oligonucleotide
tgcctgggacacccctaggc

SEQ ID NO: 2091 - DNA, 20 bp, Artificial sequence
  Synthetic oligonucleotide
taaaaagtaatttagctccc

SEQ ID NO: 2092 - DNA, 20 bp, Artificial sequence
  Synthetic oligonucleotide
attttgttccttagctaaga

SEQ ID NO: 2093 - DNA, 20 bp, Artificial sequence
  Synthetic oligonucleotide
ggtcctaaatattctagtcc

SEQ ID NO: 2094 - DNA, 20 bp, Artificial sequence
  Synthetic oligonucleotide
tcagcctggttagcctttct

SEQ ID NO: 2095 - DNA, 20 bp, Artificial sequence
  Synthetic oligonucleotide
gatttggcagtattacctct

SEQ ID NO: 2096 - DNA, 20 bp, Artificial sequence
  Synthetic oligonucleotide
ctttagtgacctgtgactat

SEQ ID NO: 2097 - DNA, 20 bp, Artificial sequence
  Synthetic oligonucleotide
acttctctctgccatttatc

SEQ ID NO: 2098 - DNA, 20 bp, Artificial sequence
  Synthetic oligonucleotide
aattaactaaaataaaggct

SEQ ID NO: 2099 - DNA, 20 bp, Artificial sequence
  Synthetic oligonucleotide
agaccagagctcaagaagtc

SEQ ID NO: 2100 - DNA, 20 bp, Artificial sequence
  Synthetic oligonucleotide
cccagcacggtattgaaatc

SEQ ID NO: 2101 - DNA, 20 bp, Artificial sequence
  Synthetic oligonucleotide
atagtgctgctgccagagtc

SEQ ID NO: 2102 - DNA, 20 bp, Artificial sequence
  Synthetic oligonucleotide
ctctcccatgcccggcttcc

SEQ ID NO: 2103 - DNA, 20 bp, Artificial sequence
  Synthetic oligonucleotide
catggcctggccttgagaat

SEQ ID NO: 2104 - DNA, 20 bp, Artificial sequence
  Synthetic oligonucleotide
ccccttagaacagcctatgg

SEQ ID NO: 2105 - DNA, 20 bp, Artificial sequence
  Synthetic oligonucleotide
tgtgtattaggatcccatct

SEQ ID NO: 2106 - DNA, 20 bp, Artificial sequence
  Synthetic oligonucleotide
agtgaaagctactaacttta

SEQ ID NO: 2107 - DNA, 20 bp, Artificial sequence
  Synthetic oligonucleotide
aatcccctcttcccattccc

SEQ ID NO: 2108 - DNA, 20 bp, Artificial sequence
  Synthetic oligonucleotide
ctggcgagtggtaagctgct

SEQ ID NO: 2109 - DNA, 20 bp, Artificial sequence
  Synthetic oligonucleotide
tccaccaccacgaggctgtg

SEQ ID NO: 2110 - DNA, 20 bp, Artificial sequence
  Synthetic oligonucleotide
gaggcgggtgccaggaccca

SEQ ID NO: 2111 - DNA, 20 bp, Artificial sequence
  Synthetic oligonucleotide
cgcagctcagcctggtagac

SEQ ID NO: 2112 - DNA, 20 bp, Artificial sequence
  Synthetic oligonucleotide
tctcctcctccagcgactca

SEQ ID NO: 2113 - DNA, 20 bp, Artificial sequence
  Synthetic oligonucleotide
ctgtcaggtctgcaaacttg

SEQ ID NO: 2114 - DNA, 20 bp, Artificial sequence
  Synthetic oligonucleotide
tcttgaggtggccttctgac

SEQ ID NO: 2115 - DNA, 20 bp, Artificial sequence
  Synthetic oligonucleotide
ttctgctcgggcccctcatg

SEQ ID NO: 2116 - DNA, 20 bp, Artificial sequence
  Synthetic oligonucleotide
ggtgggtgccgtctggcagg

SEQ ID NO: 2117 - DNA, 20 bp, Artificial sequence
  Synthetic oligonucleotide
tggagggcgatgtagtaggt

SEQ ID NO: 2118 - DNA, 20 bp, Artificial sequence
  Synthetic oligonucleotide
gtctgagtctcagttttcct

SEQ ID NO: 2119 - DNA, 20 bp, Artificial sequence
  Synthetic oligonucleotide
acctcataaaaaccaaaaga

SEQ ID NO: 2120 - DNA, 20 bp, Artificial sequence
  Synthetic oligonucleotide
taggcagcatagggatatcc

SEQ ID NO: 2121 - DNA, 20 bp, Artificial sequence
  Synthetic oligonucleotide
ggactgagacacttgagtca

SEQ ID NO: 2122 - DNA, 20 bp, Artificial sequence
  Synthetic oligonucleotide
gcgccatcccaattgcctcc

SEQ ID NO: 2123 - DNA, 20 bp, Artificial sequence
  Synthetic oligonucleotide
ctgtttcagcatcttcaaga

SEQ ID NO: 2124 - DNA, 20 bp, Artificial sequence
  Synthetic oligonucleotide
tgggacaaagtcatgccctg

SEQ ID NO: 2125 - DNA, 20 bp, Artificial sequence
  Synthetic oligonucleotide
gcctggtatgacacagcaag

SEQ ID NO: 2126 - DNA, 20 bp, Artificial sequence
  Synthetic oligonucleotide
ctacctagaatactgggtac

SEQ ID NO: 2127 - DNA, 20 bp, Artificial sequence
  Synthetic oligonucleotide
tgagccagtgtcttcacttt

SEQ ID NO: 2128 - DNA, 20 bp, Artificial sequence
  Synthetic oligonucleotide
agcagtgccctgaagattag

SEQ ID NO: 2129 - DNA, 20 bp, Artificial sequence
  Synthetic oligonucleotide
tttccccgtctttggtgctt

SEQ ID NO: 2130 - DNA, 20 bp, Artificial sequence
  Synthetic oligonucleotide
ccatttacaatctggtgagc

SEQ ID NO: 2131 - DNA, 20 bp, Artificial sequence
  Synthetic oligonucleotide
tcctgggaaaatgacgcagt

SEQ ID NO: 2132 - DNA, 20 bp, Artificial sequence
  Synthetic oligonucleotide
tcccagtgacaggaagaggt

SEQ ID NO: 2133 - DNA, 20 bp, Artificial sequence
  Synthetic oligonucleotide
atcctctgaactgagtcagc

SEQ ID NO: 2134 - DNA, 20 bp, Artificial sequence
  Synthetic oligonucleotide
gaacataaaactttattcac

SEQ ID NO: 2135 - DNA, 20 bp, Artificial sequence
  Synthetic oligonucleotide
tccagtgcccttcccacgag

SEQ ID NO: 2136 - DNA, 20 bp, Artificial sequence
  Synthetic oligonucleotide
tagaagtaccctggtatgat

SEQ ID NO: 2137 - DNA, 20 bp, Artificial sequence
  Synthetic oligonucleotide
ttgccccctgtagtgacaag

SEQ ID NO: 2138 - DNA, 20 bp, Artificial sequence
  Synthetic oligonucleotide
attcagccccttctgctcac

SEQ ID NO: 2139 - DNA, 20 bp, Artificial sequence
  Synthetic oligonucleotide
ctgctttccccagtagggag

SEQ ID NO: 2140 - DNA, 20 bp, Artificial sequence
  Synthetic oligonucleotide
cttcaccccagaatccaatc

SEQ ID NO: 2141 - DNA, 20 bp, Artificial sequence
  Synthetic oligonucleotide
tggcaggcagtcacctgtgc

SEQ ID NO: 2142 - DNA, 20 bp, Artificial sequence
  Synthetic oligonucleotide
gaaggcacacatgcatgtcc

SEQ ID NO: 2143 - DNA, 20 bp, Artificial sequence
  Synthetic oligonucleotide
acctgcttctgctcacacag

SEQ ID NO: 2144 - DNA, 20 bp, Artificial sequence
  Synthetic oligonucleotide
ttctgaggacacttgaatac

SEQ ID NO: 2145 - DNA, 20 bp, Artificial sequence
  Synthetic oligonucleotide
tctgcttcctggagtggcag

SEQ ID NO: 2146 - DNA, 20 bp, Artificial sequence
  Synthetic oligonucleotide
tctctcctctctctgagtgt

SEQ ID NO: 2147 - DNA, 20 bp, Artificial sequence
  Synthetic oligonucleotide
ctcttgtctctttccgtctc

SEQ ID NO: 2148 - DNA, 20 bp, Artificial sequence
  Synthetic oligonucleotide
aagcggtaccagggctcagg

SEQ ID NO: 2149 - DNA, 20 bp, Artificial sequence
  Synthetic oligonucleotide
tattctcccagcttcctcca

SEQ ID NO: 2150 - DNA, 20 bp, Artificial sequence
  Synthetic oligonucleotide
ttttgaaagcaatagtgcct

SEQ ID NO: 2151 - DNA, 20 bp, Artificial sequence
  Synthetic oligonucleotide
tagaacagaacagtatcagc

SEQ ID NO: 2152 - DNA, 20 bp, Artificial sequence
  Synthetic oligonucleotide
tacttcatagtaaggtaatc

SEQ ID NO: 2153 - DNA, 20 bp, Artificial sequence
  Synthetic oligonucleotide
cccaaaacagactggcagag

SEQ ID NO: 2154 - DNA, 20 bp, Artificial sequence
  Synthetic oligonucleotide
atatcacaccttccaggtca

SEQ ID NO: 2155 - DNA, 20 bp, Artificial sequence
  Synthetic oligonucleotide
acatataagctctgagctgt

SEQ ID NO: 2156 - DNA, 20 bp, Artificial sequence
  Synthetic oligonucleotide
cgtgcctgtcctgcctagcc

SEQ ID NO: 2157 - DNA, 20 bp, Artificial sequence
  Synthetic oligonucleotide
acactcctcagctaggtgcc

SEQ ID NO: 2158 - DNA, 20 bp, Artificial sequence
  Synthetic oligonucleotide
ttctcccctgcctgcaggga

SEQ ID NO: 2159 - DNA, 20 bp, Artificial sequence
  Synthetic oligonucleotide
tgaatgaacagtgccacaga

SEQ ID NO: 2160 - DNA, 20 bp, Artificial sequence
  Synthetic oligonucleotide
gcaccccagttaaccccagg

SEQ ID NO: 2161 - DNA, 20 bp, Artificial sequence
  Synthetic oligonucleotide
cccgtccccgtcctgccctg

SEQ ID NO: 2162 - DNA, 20 bp, Artificial sequence
  Synthetic oligonucleotide
aggtttcgaggcccggcccc

SEQ ID NO: 2163 - DNA, 20 bp, Artificial sequence
  Synthetic oligonucleotide
gatctgcacacaaggctgaa

SEQ ID NO: 2164 - DNA, 20 bp, Artificial sequence
  Synthetic oligonucleotide
gaggcctaatcaatattggt

SEQ ID NO: 2165 - DNA, 20 bp, Artificial sequence
  Synthetic oligonucleotide
gatgggtgaggtgaggagtc

SEQ ID NO: 2166 - DNA, 20 bp, Artificial sequence
  Synthetic oligonucleotide
cgcatgtctatctgaaggaa

SEQ ID NO: 2167 - DNA, 20 bp, Artificial sequence
  Synthetic oligonucleotide
tcctgaaagaaagcagaggg

SEQ ID NO: 2168 - DNA, 20 bp, Artificial sequence
  Synthetic oligonucleotide
gtaaaaagtaatttagctcc

SEQ ID NO: 2169 - DNA, 20 bp, Artificial sequence
  Synthetic oligonucleotide
aattttgttccttagctaag

SEQ ID NO: 2170 - DNA, 20 bp, Artificial sequence
  Synthetic oligonucleotide
tggtcctaaatattctagtc

SEQ ID NO: 2171 - DNA, 20 bp, Artificial sequence
  Synthetic oligonucleotide
gtcagcctggttagcctttc

SEQ ID NO: 2172 - DNA, 20 bp, Artificial sequence
  Synthetic oligonucleotide
ggatttggcagtattacctc

SEQ ID NO: 2173 - DNA, 20 bp, Artificial sequence
  Synthetic oligonucleotide
gctttagtgacctgtgacta

SEQ ID NO: 2174 - DNA, 20 bp, Artificial sequence
  Synthetic oligonucleotide
tacttctctctgccatttat

SEQ ID NO: 2175 - DNA, 20 bp, Artificial sequence
  Synthetic oligonucleotide
caattaactaaaataaaggc

SEQ ID NO: 2176 - DNA, 20 bp, Artificial sequence
  Synthetic oligonucleotide
ggatcaggagaccagagctc

SEQ ID NO: 2177 - DNA, 20 bp, Artificial sequence
  Synthetic oligonucleotide
acccagcacggtattgaaat

SEQ ID NO: 2178 - DNA, 20 bp, Artificial sequence
  Synthetic oligonucleotide
ccaaatcccaatagtgctgc

SEQ ID NO: 2179 - DNA, 20 bp, Artificial sequence
  Synthetic oligonucleotide
atcctctcccatgcccggct

SEQ ID NO: 2180 - DNA, 20 bp, Artificial sequence
  Synthetic oligonucleotide
tgtgccagccccaggctttc

SEQ ID NO: 2181 - DNA, 20 bp, Artificial sequence
  Synthetic oligonucleotide
ggctccccttagaacagcct

SEQ ID NO: 2182 - DNA, 20 bp, Artificial sequence
  Synthetic oligonucleotide
agtgtgtattaggatcccat

SEQ ID NO: 2183 - DNA, 20 bp, Artificial sequence
  Synthetic oligonucleotide
aagtgaaagctactaacttt

SEQ ID NO: 2184 - DNA, 20 bp, Artificial sequence
  Synthetic oligonucleotide
aaatcccctcttcccattcc

SEQ ID NO: 2185 - DNA, 20 bp, Artificial sequence
  Synthetic oligonucleotide
agataacactgggaaagcat

SEQ ID NO: 2186 - DNA, 20 bp, Artificial sequence
  Synthetic oligonucleotide
ggtccaccaccacgaggctg

SEQ ID NO: 2187 - DNA, 20 bp, Artificial sequence
  Synthetic oligonucleotide
ggagaaatccacccgggtcg

SEQ ID NO: 2188 - DNA, 20 bp, Artificial sequence
  Synthetic oligonucleotide
tcgcagctcagcctggtaga

SEQ ID NO: 2189 - DNA, 20 bp, Artificial sequence
  Synthetic oligonucleotide
tcaagaaccggatctcctcc

SEQ ID NO: 2190 - DNA, 20 bp, Artificial sequence
  Synthetic oligonucleotide
ggtcaaggactgcaactggc

SEQ ID NO: 2191 - DNA, 20 bp, Artificial sequence
  Synthetic oligonucleotide
atgttcctcttgaggtggcc

SEQ ID NO: 2192 - DNA, 20 bp, Artificial sequence
  Synthetic oligonucleotide
cttctgctcgggcccctcat

SEQ ID NO: 2193 - DNA, 20 bp, Artificial sequence
  Synthetic oligonucleotide
ttcttgttagttggagttgc

SEQ ID NO: 2194 - DNA, 20 bp, Artificial sequence
  Synthetic oligonucleotide
atgtggagggcgatgtagta

SEQ ID NO: 2195 - DNA, 20 bp, Artificial sequence
  Synthetic oligonucleotide
ccctttcctgtctgagtctc

SEQ ID NO: 2196 - DNA, 20 bp, Artificial sequence
  Synthetic oligonucleotide
cacctcataaaaaccaaaag

SEQ ID NO: 2197 - DNA, 20 bp, Artificial sequence
  Synthetic oligonucleotide
gaacaaccctctgagctggg

SEQ ID NO: 2198 - DNA, 20 bp, Artificial sequence
  Synthetic oligonucleotide
atggcagctcaggtggactg

SEQ ID NO: 2199 - DNA, 20 bp, Artificial sequence
  Synthetic oligonucleotide
cctacttgtatgcctagcgc

SEQ ID NO: 2200 - DNA, 20 bp, Artificial sequence
  Synthetic oligonucleotide
cctgtttcagcatcttcaag

SEQ ID NO: 2201 - DNA, 20 bp, Artificial sequence
  Synthetic oligonucleotide
atgggacaaagtcatgccct

SEQ ID NO: 2202 - DNA, 20 bp, Artificial sequence
  Synthetic oligonucleotide
aagaagcagcagtcccaggg

SEQ ID NO: 2203 - DNA, 20 bp, Artificial sequence
  Synthetic oligonucleotide
gcactacctagaatactggg

SEQ ID NO: 2204 - DNA, 20 bp, Artificial sequence
  Synthetic oligonucleotide
atgagccagtgtcttcactt

SEQ ID NO: 2205 - DNA, 20 bp, Artificial sequence
  Synthetic oligonucleotide
gcagcagtgccctgaagatt

SEQ ID NO: 2206 - DNA, 20 bp, Artificial sequence
  Synthetic oligonucleotide
ttttccccgtctttggtgct

SEQ ID NO: 2207 - DNA, 20 bp, Artificial sequence
  Synthetic oligonucleotide
tccatttacaatctggtgag

SEQ ID NO: 2208 - DNA, 20 bp, Artificial sequence
  Synthetic oligonucleotide
ttcctgggaaaatgacgcag

SEQ ID NO: 2209 - DNA, 20 bp, Artificial sequence
  Synthetic oligonucleotide
cctcccagtgacaggaagag

SEQ ID NO: 2210 - DNA, 20 bp, Artificial sequence
  Synthetic oligonucleotide
aatcctctgaactgagtcag

SEQ ID NO: 2211 - DNA, 20 bp, Artificial sequence
  Synthetic oligonucleotide
ggaacataaaactttattca

SEQ ID NO: 2212 - DNA, 20 bp, Artificial sequence
  Synthetic oligonucleotide
actccagtgcccttcccacg

SEQ ID NO: 2213 - DNA, 20 bp, Artificial sequence
  Synthetic oligonucleotide
ctagaagtaccctggtatga

SEQ ID NO: 2214 - DNA, 20 bp, Artificial sequence
  Synthetic oligonucleotide
ttttgccccctgtagtgaca

SEQ ID NO: 2215 - DNA, 20 bp, Artificial sequence
  Synthetic oligonucleotide
tccctgagacttctcgggca

SEQ ID NO: 2216 - DNA, 20 bp, Artificial sequence
  Synthetic oligonucleotide
actgctttccccagtaggga

SEQ ID NO: 2217 - DNA, 20 bp, Artificial sequence
  Synthetic oligonucleotide
ctttcttcaccccagaatcc

SEQ ID NO: 2218 - DNA, 20 bp, Artificial sequence
  Synthetic oligonucleotide
gtggcaggcagtcacctgtg

SEQ ID NO: 2219 - DNA, 20 bp, Artificial sequence
  Synthetic oligonucleotide
tgaaggcacacatgcatgtc

SEQ ID NO: 2220 - DNA, 20 bp, Artificial sequence
  Synthetic oligonucleotide
cacctgcttctgctcacaca

SEQ ID NO: 2221 - DNA, 20 bp, Artificial sequence
  Synthetic oligonucleotide
cctgacctgtctataggcag

SEQ ID NO: 2222 - DNA, 20 bp, Artificial sequence
  Synthetic oligonucleotide
atctgcttcctggagtggca

SEQ ID NO: 2223 - DNA, 20 bp, Artificial sequence
  Synthetic oligonucleotide
ttctctcctctctctgagtg

SEQ ID NO: 2224 - DNA, 20 bp, Artificial sequence
  Synthetic oligonucleotide
ctctcttgtctctttccgtc

SEQ ID NO: 2225 - DNA, 20 bp, Artificial sequence
  Synthetic oligonucleotide
gaagcggtaccagggctcag

SEQ ID NO: 2226 - DNA, 20 bp, Artificial sequence
  Synthetic oligonucleotide
atattctcccagcttcctcc

SEQ ID NO: 2227 - DNA, 20 bp, Artificial sequence
  Synthetic oligonucleotide
ggtacttttgaaagcaatag

SEQ ID NO: 2228 - DNA, 20 bp, Artificial sequence
  Synthetic oligonucleotide
ggcttagaacagaacagtat

SEQ ID NO: 2229 - DNA, 20 bp, Artificial sequence
  Synthetic oligonucleotide
cagcacctacttcatagtaa

SEQ ID NO: 2230 - DNA, 20 bp, Artificial sequence
  Synthetic oligonucleotide
gaggctcagtaacccaaaac

SEQ ID NO: 2231 - DNA, 20 bp, Artificial sequence
  Synthetic oligonucleotide
aatatcacaccttccaggtc

SEQ ID NO: 2232 - DNA, 20 bp, Artificial sequence
  Synthetic oligonucleotide
ctacatataagctctgagct

SEQ ID NO: 2233 - DNA, 20 bp, Artificial sequence
  Synthetic oligonucleotide
aggaatggccctcccttctt

SEQ ID NO: 2234 - DNA, 20 bp, Artificial sequence
  Synthetic oligonucleotide
cacactcctcagctaggtgc

SEQ ID NO: 2235 - DNA, 20 bp, Artificial sequence
  Synthetic oligonucleotide
gccctttctcccctgcctgc

SEQ ID NO: 2236 - DNA, 20 bp, Artificial sequence
  Synthetic oligonucleotide
aatgaatgaacagtgccaca

SEQ ID NO: 2237 - DNA, 20 bp, Artificial sequence
  Synthetic oligonucleotide
gtgagcagcaccccagttaa

SEQ ID NO: 2238 - DNA, 20 bp, Artificial sequence
  Synthetic oligonucleotide
tccgcccgtccccgtcctgc

SEQ ID NO: 2239 - DNA, 20 bp, Artificial sequence
  Synthetic oligonucleotide
gaggtttcgaggcccggccc

SEQ ID NO: 2240 - DNA, 20 bp, Artificial sequence
  Synthetic oligonucleotide
ggatctgcacacaaggctga

SEQ ID NO: 2241 - DNA, 20 bp, Artificial sequence
  Synthetic oligonucleotide
tgaggcctaatcaatattgg

SEQ ID NO: 2242 - DNA, 20 bp, Artificial sequence
  Synthetic oligonucleotide
agagatgggtgaggtgagga

SEQ ID NO: 2243 - DNA, 20 bp, Artificial sequence
  Synthetic oligonucleotide
cttgagtgttatctgggagg

SEQ ID NO: 2244 - DNA, 20 bp, Artificial sequence
  Synthetic oligonucleotide
gggaatggtgatcctgaaag

SEQ ID NO: 2245 - DNA, 20 bp, Artificial sequence
  Synthetic oligonucleotide
aagtaaaaagtaatttagct

SEQ ID NO: 2246 - DNA, 20 bp, Artificial sequence
  Synthetic oligonucleotide
gaattttgttccttagctaa

SEQ ID NO: 2247 - DNA, 20 bp, Artificial sequence
  Synthetic oligonucleotide
gagacatgcatatctagtgg

SEQ ID NO: 2248 - DNA, 20 bp, Artificial sequence
  Synthetic oligonucleotide
tagtcagcctggttagcctt

SEQ ID NO: 2249 - DNA, 20 bp, Artificial sequence
  Synthetic oligonucleotide
tatctaggatttggcagtat

SEQ ID NO: 2250 - DNA, 20 bp, Artificial sequence
  Synthetic oligonucleotide
gtgctttagtgacctgtgac

SEQ ID NO: 2251 - DNA, 20 bp, Artificial sequence
  Synthetic oligonucleotide
cctacttctctctgccattt

SEQ ID NO: 2252 - DNA, 20 bp, Artificial sequence
  Synthetic oligonucleotide
acaattaactaaaataaagg

SEQ ID NO: 2253 - DNA, 20 bp, Artificial sequence
  Synthetic oligonucleotide
gtaatccccttactcgggag

SEQ ID NO: 2254 - DNA, 20 bp, Artificial sequence
  Synthetic oligonucleotide
aacccagcacggtattgaaa

SEQ ID NO: 2255 - DNA, 20 bp, Artificial sequence
  Synthetic oligonucleotide
cccaaatcccaatagtgctg

SEQ ID NO: 2256 - DNA, 20 bp, Artificial sequence
  Synthetic oligonucleotide
agccatcctctcccatgccc

SEQ ID NO: 2257 - DNA, 20 bp, Artificial sequence
  Synthetic oligonucleotide
tctatgtgccagccccaggc

SEQ ID NO: 2258 - DNA, 20 bp, Artificial sequence
  Synthetic oligonucleotide
aggctccccttagaacagcc

SEQ ID NO: 2259 - DNA, 20 bp, Artificial sequence
  Synthetic oligonucleotide
gagtgtgtattaggatccca

SEQ ID NO: 2260 - DNA, 20 bp, Artificial sequence
  Synthetic oligonucleotide
ggaagtgaaagctactaact

SEQ ID NO: 2261 - DNA, 20 bp, Artificial sequence
  Synthetic oligonucleotide
ccaaatcccctcttcccatt

SEQ ID NO: 2262 - DNA, 20 bp, Artificial sequence
  Synthetic oligonucleotide
tgagataacactgggaaagc

SEQ ID NO: 2263 - DNA, 20 bp, Artificial sequence
  Synthetic oligonucleotide
accccaggtccaccaccacg

SEQ ID NO: 2264 - DNA, 20 bp, Artificial sequence
  Synthetic oligonucleotide
tgccccagccagggagaaat

SEQ ID NO: 2265 - DNA, 20 bp, Artificial sequence
  Synthetic oligonucleotide
ctcgcagctcagcctggtag

SEQ ID NO: 2266 - DNA, 20 bp, Artificial sequence
  Synthetic oligonucleotide
ttcctcaagaaccggatctc

SEQ ID NO: 2267 - DNA, 20 bp, Artificial sequence
  Synthetic oligonucleotide
cgcaggtcaaggactgcaac

SEQ ID NO: 2268 - DNA, 20 bp, Artificial sequence
  Synthetic oligonucleotide
gatgttcctcttgaggtggc

SEQ ID NO: 2269 - DNA, 20 bp, Artificial sequence
  Synthetic oligonucleotide
gcttctgctcgggcccctca

SEQ ID NO: 2270 - DNA, 20 bp, Artificial sequence
  Synthetic oligonucleotide
gtttcttgttagttggagtt

SEQ ID NO: 2271 - DNA, 20 bp, Artificial sequence
  Synthetic oligonucleotide
gatgtggagggcgatgtagt

SEQ ID NO: 2272 - DNA, 20 bp, Artificial sequence
  Synthetic oligonucleotide
ttccctttcctgtctgagtc

SEQ ID NO: 2273 - DNA, 20 bp, Artificial sequence
  Synthetic oligonucleotide
ccacctcataaaaaccaaaa

SEQ ID NO: 2274 - DNA, 20 bp, Artificial sequence
  Synthetic oligonucleotide
agaacaaccctctgagctgg

SEQ ID NO: 2275 - DNA, 20 bp, Artificial sequence
  Synthetic oligonucleotide
caagtgctgagaatcaagct

SEQ ID NO: 2276 - DNA, 20 bp, Artificial sequence
  Synthetic oligonucleotide
tccagaggccaagtgcaact

SEQ ID NO: 2277 - DNA, 20 bp, Artificial sequence
  Synthetic oligonucleotide
tcctgtttcagcatcttcaa

SEQ ID NO: 2278 - DNA, 20 bp, Artificial sequence
  Synthetic oligonucleotide
aatgggacaaagtcatgccc

SEQ ID NO: 2279 - DNA, 20 bp, Artificial sequence
  Synthetic oligonucleotide
aaaagcagccggtcactatg

SEQ ID NO: 2280 - DNA, 20 bp, Artificial sequence
  Synthetic oligonucleotide
agggcactacctagaatact

SEQ ID NO: 2281 - DNA, 20 bp, Artificial sequence
  Synthetic oligonucleotide
cagccctgagcacccggcct

SEQ ID NO: 2282 - DNA, 20 bp, Artificial sequence
  Synthetic oligonucleotide
cagcagcagtgccctgaaga

SEQ ID NO: 2283 - DNA, 20 bp, Artificial sequence
  Synthetic oligonucleotide
attttccccgtctttggtgc

SEQ ID NO: 2284 - DNA, 20 bp, Artificial sequence
  Synthetic oligonucleotide
ggcaggcagctaaccgcgag

SEQ ID NO: 2285 - DNA, 20 bp, Artificial sequence
  Synthetic oligonucleotide
gttcctgggaaaatgacgca

SEQ ID NO: 2286 - DNA, 20 bp, Artificial sequence
  Synthetic oligonucleotide
gccctcccagtgacaggaag

SEQ ID NO: 2287 - DNA, 20 bp, Artificial sequence
  Synthetic oligonucleotide
aagaatcctctgaactgagt

SEQ ID NO: 2288 - DNA, 20 bp, Artificial sequence
  Synthetic oligonucleotide
gggaacataaaactttattc

SEQ ID NO: 2289 - DNA, 20 bp, Artificial sequence
  Synthetic oligonucleotide
ggactccagtgcccttccca

SEQ ID NO: 2290 - DNA, 20 bp, Artificial sequence
  Synthetic oligonucleotide
cctagaagtaccctggtatg

SEQ ID NO: 2291 - DNA, 20 bp, Artificial sequence
  Synthetic oligonucleotide
gcttttgccccctgtagtga

SEQ ID NO: 2292 - DNA, 20 bp, Artificial sequence
  Synthetic oligonucleotide
ctccctgagacttctcgggc

SEQ ID NO: 2293 - DNA, 20 bp, Artificial sequence
  Synthetic oligonucleotide
gcactgctttccccagtagg

SEQ ID NO: 2294 - DNA, 20 bp, Artificial sequence
  Synthetic oligonucleotide
actttcttcaccccagaatc

SEQ ID NO: 2295 - DNA, 20 bp, Artificial sequence
  Synthetic oligonucleotide
agtcaaagtaacttgatggg

SEQ ID NO: 2296 - DNA, 20 bp, Artificial sequence
  Synthetic oligonucleotide
ttgaaggcacacatgcatgt

SEQ ID NO: 2297 - DNA, 20 bp, Artificial sequence
  Synthetic oligonucleotide
aggatgagcagatgtgggct

SEQ ID NO: 2298 - DNA, 20 bp, Artificial sequence
  Synthetic oligonucleotide
ccctgacctgtctataggca

SEQ ID NO: 2299 - DNA, 20 bp, Artificial sequence
  Synthetic oligonucleotide
tcatctgcttcctggagtgg

SEQ ID NO: 2300 - DNA, 20 bp, Artificial sequence
  Synthetic oligonucleotide
tttctctcctctctctgagt

SEQ ID NO: 2301 - DNA, 20 bp, Artificial sequence
  Synthetic oligonucleotide
aatgctctcttgtctctttc

SEQ ID NO: 2302 - DNA, 20 bp, Artificial sequence
  Synthetic oligonucleotide
agaagcggtaccagggctca

SEQ ID NO: 2303 - DNA, 20 bp, Artificial sequence
  Synthetic oligonucleotide
agtcagtcacctggagagga

SEQ ID NO: 2304 - DNA, 20 bp, Artificial sequence
  Synthetic oligonucleotide
taatgggtacttttgaaagc

SEQ ID NO: 2305 - DNA, 20 bp, Artificial sequence
  Synthetic oligonucleotide
gggcttagaacagaacagta

SEQ ID NO: 2306 - DNA, 20 bp, Artificial sequence
  Synthetic oligonucleotide
acagcacctacttcatagta

SEQ ID NO: 2307 - DNA, 20 bp, Artificial sequence
  Synthetic oligonucleotide
tagaggctcagtaacccaaa

SEQ ID NO: 2308 - DNA, 20 bp, Artificial sequence
  Synthetic oligonucleotide
caatatcacaccttccaggt

SEQ ID NO: 2309 - DNA, 20 bp, Artificial sequence
  Synthetic oligonucleotide
cactacatataagctctgag

SEQ ID NO: 2310 - DNA, 20 bp, Artificial sequence
  Synthetic oligonucleotide
taggaatggccctcccttct

SEQ ID NO: 2311 - DNA, 20 bp, Artificial sequence
  Synthetic oligonucleotide
actcacactcctcagctagg

SEQ ID NO: 2312 - DNA, 20 bp, Artificial sequence
  Synthetic oligonucleotide
taatagccctttctcccctg

SEQ ID NO: 2313 - DNA, 20 bp, Artificial sequence
  Synthetic oligonucleotide
cgaatgaatgaacagtgcca

SEQ ID NO: 2314 - DNA, 20 bp, Artificial sequence
  Synthetic oligonucleotide
agggaggtgagcagcacccc

SEQ ID NO: 2315 - DNA, 20 bp, Artificial sequence
  Synthetic oligonucleotide
gctccgcccgtccccgtcct

SEQ ID NO: 2316 - DNA, 20 bp, Artificial sequence
  Synthetic oligonucleotide
ggaggtttcgaggcccggcc

SEQ ID NO: 2317 - DNA, 20 bp, Artificial sequence
  Synthetic oligonucleotide
gggatctgcacacaaggctg

SEQ ID NO: 2318 - DNA, 20 bp, Artificial sequence
  Synthetic oligonucleotide
ttgaggcctaatcaatattg

SEQ ID NO: 2319 - DNA, 20 bp, Artificial sequence
  Synthetic oligonucleotide
gaagagatgggtgaggtgag

SEQ ID NO: 2320 - DNA, 20 bp, Artificial sequence
  Synthetic oligonucleotide
ctttttccccagcagccaac

SEQ ID NO: 2321 - DNA, 20 bp, Artificial sequence
  Synthetic oligonucleotide
tcacattcactaatatttaa

SEQ ID NO: 2322 - DNA, 20 bp, Artificial sequence
  Synthetic oligonucleotide
caagtaaaaagtaatttagc

SEQ ID NO: 2323 - DNA, 20 bp, Artificial sequence
  Synthetic oligonucleotide
agaggaattttgttccttag

SEQ ID NO: 2324 - DNA, 20 bp, Artificial sequence
  Synthetic oligonucleotide
tcctgagacatgcatatcta

SEQ ID NO: 2325 - DNA, 20 bp, Artificial sequence
  Synthetic oligonucleotide
actagtcagcctggttagcc

SEQ ID NO: 2326 - DNA, 20 bp, Artificial sequence
  Synthetic oligonucleotide
actatctaggatttggcagt

SEQ ID NO: 2327 - DNA, 20 bp, Artificial sequence
  Synthetic oligonucleotide
ctgtgctttagtgacctgtg

SEQ ID NO: 2328 - DNA, 20 bp, Artificial sequence
  Synthetic oligonucleotide
agtgctcaatacacataggt

SEQ ID NO: 2329 - DNA, 20 bp, Artificial sequence
  Synthetic oligonucleotide
gacaattaactaaaataaag

SEQ ID NO: 2330 - DNA, 20 bp, Artificial sequence
  Synthetic oligonucleotide
actccgtcgaaagcaggcaa

SEQ ID NO: 2331 - DNA, 20 bp, Artificial sequence
  Synthetic oligonucleotide
aaacccagcacggtattgaa

SEQ ID NO: 2332 - DNA, 20 bp, Artificial sequence
  Synthetic oligonucleotide
tcttccaaacgggctggaga

SEQ ID NO: 2333 - DNA, 20 bp, Artificial sequence
  Synthetic oligonucleotide
catgagccatcctctcccat

SEQ ID NO: 2334 - DNA, 20 bp, Artificial sequence
  Synthetic oligonucleotide
ttgctgggaaccttctatgt

SEQ ID NO: 2335 - DNA, 20 bp, Artificial sequence
  Synthetic oligonucleotide
aaggctccccttagaacagc

SEQ ID NO: 2336 - DNA, 20 bp, Artificial sequence
  Synthetic oligonucleotide
agagtgtgtattaggatccc

SEQ ID NO: 2337 - DNA, 20 bp, Artificial sequence
  Synthetic oligonucleotide
gagttggaagtgaaagctac

SEQ ID NO: 2338 - DNA, 20 bp, Artificial sequence
  Synthetic oligonucleotide
cgtggcggatacgccaaatc

SEQ ID NO: 2339 - DNA, 20 bp, Artificial sequence
  Synthetic oligonucleotide
gtgagataacactgggaaag

SEQ ID NO: 2340 - DNA, 20 bp, Artificial sequence
  Synthetic oligonucleotide
ttcacacagaccccaggtcc

SEQ ID NO: 2341 - DNA, 20 bp, Artificial sequence
  Synthetic oligonucleotide
gagtgccccagccagggaga

SEQ ID NO: 2342 - DNA, 20 bp, Artificial sequence
  Synthetic oligonucleotide
gcggtgagttgatcgagccg

SEQ ID NO: 2343 - DNA, 20 bp, Artificial sequence
  Synthetic oligonucleotide
cttcctcaagaaccggatct

SEQ ID NO: 2344 - DNA, 20 bp, Artificial sequence
  Synthetic oligonucleotide
gtcgcaggtcaaggactgca

SEQ ID NO: 2345 - DNA, 20 bp, Artificial sequence
  Synthetic oligonucleotide
gcatctccacggtcttcacc

SEQ ID NO: 2346 - DNA, 20 bp, Artificial sequence
  Synthetic oligonucleotide
ctgcttctgctcgggcccct

SEQ ID NO: 2347 - DNA, 20 bp, Artificial sequence
  Synthetic oligonucleotide
gagtttcttgttagttggag

SEQ ID NO: 2348 - DNA, 20 bp, Artificial sequence
  Synthetic oligonucleotide
aacaggaatcagggatgtgg

SEQ ID NO: 2349 - DNA, 20 bp, Artificial sequence
  Synthetic oligonucleotide
ccagggctaccttgtctgtg

SEQ ID NO: 2350 - DNA, 20 bp, Artificial sequence
  Synthetic oligonucleotide
tatcccacctcataaaaacc

SEQ ID NO: 2351 - DNA, 20 bp, Artificial sequence
  Synthetic oligonucleotide
taggagaacaaccctctgag

SEQ ID NO: 2352 - DNA, 20 bp, Artificial sequence
  Synthetic oligonucleotide
cccaagtgctgagaatcaag

SEQ ID NO: 2353 - DNA, 20 bp, Artificial sequence
  Synthetic oligonucleotide
aatccagaggccaagtgcaa

SEQ ID NO: 2354 - DNA, 20 bp, Artificial sequence
  Synthetic oligonucleotide
tctctcctgtttcagcatct

SEQ ID NO: 2355 - DNA, 20 bp, Artificial sequence
  Synthetic oligonucleotide
aaatgggacaaagtcatgcc

SEQ ID NO: 2356 - DNA, 20 bp, Artificial sequence
  Synthetic oligonucleotide
gcttagggaaaagcagccgg

SEQ ID NO: 2357 - DNA, 20 bp, Artificial sequence
  Synthetic oligonucleotide
tagggcactacctagaatac

SEQ ID NO: 2358 - DNA, 20 bp, Artificial sequence
  Synthetic oligonucleotide
gtcagccctgagcacccggc

SEQ ID NO: 2359 - DNA, 20 bp, Artificial sequence
  Synthetic oligonucleotide
ggcagcagcagtgccctgaa

SEQ ID NO: 2360 - DNA, 20 bp, Artificial sequence
  Synthetic oligonucleotide
tgattttccccgtctttggt

SEQ ID NO: 2361 - DNA, 20 bp, Artificial sequence
  Synthetic oligonucleotide
cgtgtctgagaggcaggcag

SEQ ID NO: 2362 - DNA, 20 bp, Artificial sequence
  Synthetic oligonucleotide
ctgcagttcctgggaaaatg

SEQ ID NO: 2363 - DNA, 20 bp, Artificial sequence
  Synthetic oligonucleotide
ggccctcccagtgacaggaa

SEQ ID NO: 2364 - DNA, 20 bp, Artificial sequence
  Synthetic oligonucleotide
gaagaatcctctgaactgag

SEQ ID NO: 2365 - DNA, 20 bp, Artificial sequence
  Synthetic oligonucleotide
agggaacataaaactttatt

SEQ ID NO: 2366 - DNA, 20 bp, Artificial sequence
  Synthetic oligonucleotide
aggactccagtgcccttccc

SEQ ID NO: 2367 - DNA, 20 bp, Artificial sequence
  Synthetic oligonucleotide
cacctagaagtaccctggta

SEQ ID NO: 2368 - DNA, 20 bp, Artificial sequence
  Synthetic oligonucleotide
gtgcttttgccccctgtagt

SEQ ID NO: 2369 - DNA, 20 bp, Artificial sequence
  Synthetic oligonucleotide
cctccctgagacttctcggg

SEQ ID NO: 2370 - DNA, 20 bp, Artificial sequence
  Synthetic oligonucleotide
tgcactgctttccccagtag

SEQ ID NO: 2371 - DNA, 20 bp, Artificial sequence
  Synthetic oligonucleotide
cactttcttcaccccagaat

SEQ ID NO: 2372 - DNA, 20 bp, Artificial sequence
  Synthetic oligonucleotide
agctgtgcaagtcaaagtaa

SEQ ID NO: 2373 - DNA, 20 bp, Artificial sequence
  Synthetic oligonucleotide
tgcacttgaaggcacacatg

SEQ ID NO: 2374 - DNA, 20 bp, Artificial sequence
  Synthetic oligonucleotide
gaggatgagcagatgtgggc

SEQ ID NO: 2375 - DNA, 20 bp, Artificial sequence
  Synthetic oligonucleotide
tccctgacctgtctataggc

SEQ ID NO: 2376 - DNA, 20 bp, Artificial sequence
  Synthetic oligonucleotide
ttcatctgcttcctggagtg

SEQ ID NO: 2377 - DNA, 20 bp, Artificial sequence
  Synthetic oligonucleotide
acctgccaatctctgtttct

SEQ ID NO: 2378 - DNA, 20 bp, Artificial sequence
  Synthetic oligonucleotide
gaatgctctcttgtctcttt

SEQ ID NO: 2379 - DNA, 20 bp, Artificial sequence
  Synthetic oligonucleotide
tgagagaagcggtaccaggg

SEQ ID NO: 2380 - DNA, 20 bp, Artificial sequence
  Synthetic oligonucleotide
aaagtcagtcacctggagag

SEQ ID NO: 2381 - DNA, 20 bp, Artificial sequence
  Synthetic oligonucleotide
cagtaataataatgggtact

SEQ ID NO: 2382 - DNA, 20 bp, Artificial sequence
  Synthetic oligonucleotide
agggcttagaacagaacagt

SEQ ID NO: 2383 - DNA, 20 bp, Artificial sequence
  Synthetic oligonucleotide
gtcaaagaacagcacctact

SEQ ID NO: 2384 - DNA, 20 bp, Artificial sequence
  Synthetic oligonucleotide
ggtagaggctcagtaaccca

SEQ ID NO: 2385 - DNA, 20 bp, Artificial sequence
  Synthetic oligonucleotide
tcaatatcacaccttccagg

SEQ ID NO: 2386 - DNA, 20 bp, Artificial sequence
  Synthetic oligonucleotide
acactacatataagctctga

SEQ ID NO: 2387 - DNA, 20 bp, Artificial sequence
  Synthetic oligonucleotide
tctgtcctccactaggaatg

SEQ ID NO: 2388 - DNA, 20 bp, Artificial sequence
  Synthetic oligonucleotide
cactcacactcctcagctag

SEQ ID NO: 2389 - DNA, 20 bp, Artificial sequence
  Synthetic oligonucleotide
ctgggttctaatagcccttt

SEQ ID NO: 2390 - DNA, 20 bp, Artificial sequence
  Synthetic oligonucleotide
gcgaatgaatgaacagtgcc

SEQ ID NO: 2391 - DNA, 20 bp, Artificial sequence
  Synthetic oligonucleotide
tcagggaggtgagcagcacc

SEQ ID NO: 2392 - DNA, 20 bp, Artificial sequence
  Synthetic oligonucleotide
cgtccctgctccgcccgtcc

SEQ ID NO: 2393 - DNA, 20 bp, Artificial sequence
  Synthetic oligonucleotide
tcccgcggagccccgacccg

SEQ ID NO: 2394 - DNA, 20 bp, Artificial sequence
  Synthetic oligonucleotide
ggaagggatctgcacacaag

SEQ ID NO: 2395 - DNA, 20 bp, Artificial sequence
  Synthetic oligonucleotide
ccttgaggcctaatcaatat

SEQ ID NO: 2396 - DNA, 20 bp, Artificial sequence
  Synthetic oligonucleotide
agaagagatgggtgaggtga

SEQ ID NO: 2397 - DNA, 20 bp, Artificial sequence
  Synthetic oligonucleotide
tctcctagctttttccccag

SEQ ID NO: 2398 - DNA, 20 bp, Artificial sequence
  Synthetic oligonucleotide
cgtcacattcactaatattt

SEQ ID NO: 2399 - DNA, 20 bp, Artificial sequence
  Synthetic oligonucleotide
ccaatgcaagtaaaaagtaa

SEQ ID NO: 2400 - DNA, 20 bp, Artificial sequence
  Synthetic oligonucleotide
aagaggaattttgttcctta

SEQ ID NO: 2401 - DNA, 20 bp, Artificial sequence
  Synthetic oligonucleotide
agtcctgagacatgcatatc

SEQ ID NO: 2402 - DNA, 20 bp, Artificial sequence
  Synthetic oligonucleotide
tactagtcagcctggttagc

SEQ ID NO: 2403 - DNA, 20 bp, Artificial sequence
  Synthetic oligonucleotide
gactatctaggatttggcag

SEQ ID NO: 2404 - DNA, 20 bp, Artificial sequence
  Synthetic oligonucleotide
tctgtgctttagtgacctgt

SEQ ID NO: 2405 - DNA, 20 bp, Artificial sequence
  Synthetic oligonucleotide
tagtgctcaatacacatagg

SEQ ID NO: 2406 - DNA, 20 bp, Artificial sequence
  Synthetic oligonucleotide
agacaattaactaaaataaa

SEQ ID NO: 2407 - DNA, 20 bp, Artificial sequence
  Synthetic oligonucleotide
gactccgtcgaaagcaggca

SEQ ID NO: 2408 - DNA, 20 bp, Artificial sequence
  Synthetic oligonucleotide
ctgaaaacccagcacggtat

SEQ ID NO: 2409 - DNA, 20 bp, Artificial sequence
  Synthetic oligonucleotide
ctcttccaaacgggctggag

SEQ ID NO: 2410 - DNA, 20 bp, Artificial sequence
  Synthetic oligonucleotide
gcatgagccatcctctccca

SEQ ID NO: 2411 - DNA, 20 bp, Artificial sequence
  Synthetic oligonucleotide
gttgctgggaaccttctatg

SEQ ID NO: 2412 - DNA, 20 bp, Artificial sequence
  Synthetic oligonucleotide
caaggctccccttagaacag

SEQ ID NO: 2413 - DNA, 20 bp, Artificial sequence
  Synthetic oligonucleotide
agagagtgtgtattaggatc

SEQ ID NO: 2414 - DNA, 20 bp, Artificial sequence
  Synthetic oligonucleotide
agagttggaagtgaaagcta

SEQ ID NO: 2415 - DNA, 20 bp, Artificial sequence
  Synthetic oligonucleotide
agatgagctcccactgtggt

SEQ ID NO: 2416 - DNA, 20 bp, Artificial sequence
  Synthetic oligonucleotide
ggtgagataacactgggaaa

SEQ ID NO: 2417 - DNA, 20 bp, Artificial sequence
  Synthetic oligonucleotide
gttcacacagaccccaggtc

SEQ ID NO: 2418 - DNA, 20 bp, Artificial sequence
  Synthetic oligonucleotide
tgagtgccccagccagggag

SEQ ID NO: 2419 - DNA, 20 bp, Artificial sequence
  Synthetic oligonucleotide
ggcggtgagttgatcgagcc

SEQ ID NO: 2420 - DNA, 20 bp, Artificial sequence
  Synthetic oligonucleotide
tcttcctcaagaaccggatc

SEQ ID NO: 2421 - DNA, 20 bp, Artificial sequence
  Synthetic oligonucleotide
cgcgcagagactccaggtcg

SEQ ID NO: 2422 - DNA, 20 bp, Artificial sequence
  Synthetic oligonucleotide
ccgcatctccacggtcttca

SEQ ID NO: 2423 - DNA, 20 bp, Artificial sequence
  Synthetic oligonucleotide
actatcctgcttctgctcgg

SEQ ID NO: 2424 - DNA, 20 bp, Artificial sequence
  Synthetic oligonucleotide
tgagtttcttgttagttgga

SEQ ID NO: 2425 - DNA, 20 bp, Artificial sequence
  Synthetic oligonucleotide
acaacaggaatcagggatgt

SEQ ID NO: 2426 - DNA, 20 bp, Artificial sequence
  Synthetic oligonucleotide
ctggccagggctaccttgtc

SEQ ID NO: 2427 - DNA, 20 bp, Artificial sequence
  Synthetic oligonucleotide
atatcccacctcataaaaac

SEQ ID NO: 2428 - DNA, 20 bp, Artificial sequence
  Synthetic oligonucleotide
tcagggtcagtctaggagaa

SEQ ID NO: 2429 - DNA, 20 bp, Artificial sequence
  Synthetic oligonucleotide
atcccccaagtgctgagaat

SEQ ID NO: 2430 - DNA, 20 bp, Artificial sequence
  Synthetic oligonucleotide
cacaatccagaggccaagtg

SEQ ID NO: 2431 - DNA, 20 bp, Artificial sequence
  Synthetic oligonucleotide
ttctctcctgtttcagcatc

SEQ ID NO: 2432 - DNA, 20 bp, Artificial sequence
  Synthetic oligonucleotide
gaaatgggacaaagtcatgc

SEQ ID NO: 2433 - DNA, 20 bp, Artificial sequence
  Synthetic oligonucleotide
ggcttagggaaaagcagccg

SEQ ID NO: 2434 - DNA, 20 bp, Artificial sequence
  Synthetic oligonucleotide
atagggcactacctagaata

SEQ ID NO: 2435 - DNA, 20 bp, Artificial sequence
  Synthetic oligonucleotide
tgtcagccctgagcacccgg

SEQ ID NO: 2436 - DNA, 20 bp, Artificial sequence
  Synthetic oligonucleotide
agcgactaaaggcagcagca

SEQ ID NO: 2437 - DNA, 20 bp, Artificial sequence
  Synthetic oligonucleotide
gtgattttccccgtctttgg

SEQ ID NO: 2438 - DNA, 20 bp, Artificial sequence
  Synthetic oligonucleotide
actccctgtcaagctgggca

SEQ ID NO: 2439 - DNA, 20 bp, Artificial sequence
  Synthetic oligonucleotide
cactgcagttcctgggaaaa

SEQ ID NO: 2440 - DNA, 20 bp, Artificial sequence
  Synthetic oligonucleotide
tccaggcacagcgagaccca

SEQ ID NO: 2441 - DNA, 20 bp, Artificial sequence
  Synthetic oligonucleotide
ggaagaatcctctgaactga

SEQ ID NO: 2442 - DNA, 20 bp, Artificial sequence
  Synthetic oligonucleotide
cagggaacataaaactttat

SEQ ID NO: 2443 - DNA, 20 bp, Artificial sequence
  Synthetic oligonucleotide
caggactccagtgcccttcc

SEQ ID NO: 2444 - DNA, 20 bp, Artificial sequence
  Synthetic oligonucleotide
cccacctagaagtaccctgg

SEQ ID NO: 2445 - DNA, 20 bp, Artificial sequence
  Synthetic oligonucleotide
tggtgcttttgccccctgta

SEQ ID NO: 2446 - DNA, 20 bp, Artificial sequence
  Synthetic oligonucleotide
ggcccctccctgagacttct

SEQ ID NO: 2447 - DNA, 20 bp, Artificial sequence
  Synthetic oligonucleotide
ctgcactgctttccccagta

SEQ ID NO: 2448 - DNA, 20 bp, Artificial sequence
  Synthetic oligonucleotide
ctttccctcactttcttcac

SEQ ID NO: 2449 - DNA, 20 bp, Artificial sequence
  Synthetic oligonucleotide
gaccaccgcttcacagctgt

SEQ ID NO: 2450 - DNA, 20 bp, Artificial sequence
  Synthetic oligonucleotide
catgtcctcctgcacttgaa

SEQ ID NO: 2451 - DNA, 20 bp, Artificial sequence
  Synthetic oligonucleotide
acagaggacttgtctggagg

SEQ ID NO: 2452 - DNA, 20 bp, Artificial sequence
  Synthetic oligonucleotide
ctccctgacctgtctatagg

SEQ ID NO: 2453 - DNA, 20 bp, Artificial sequence
  Synthetic oligonucleotide
cttcatctgcttcctggagt

SEQ ID NO: 2454 - DNA, 20 bp, Artificial sequence
  Synthetic oligonucleotide
tacctgccaatctctgtttc

SEQ ID NO: 2455 - DNA, 20 bp, Artificial sequence
  Synthetic oligonucleotide
tcgaatgctctcttgtctct

SEQ ID NO: 2456 - DNA, 20 bp, Artificial sequence
  Synthetic oligonucleotide
ggtgagagaagcggtaccag

SEQ ID NO: 2457 - DNA, 20 bp, Artificial sequence
  Synthetic oligonucleotide
tgaaagtcagtcacctggag

SEQ ID NO: 2458 - DNA, 20 bp, Artificial sequence
  Synthetic oligonucleotide
gcagtaataataatgggtac

SEQ ID NO: 2459 - DNA, 20 bp, Artificial sequence
  Synthetic oligonucleotide
cagggcttagaacagaacag

SEQ ID NO: 2460 - DNA, 20 bp, Artificial sequence
  Synthetic oligonucleotide
ctctcatctgtcaaagaaca

SEQ ID NO: 2461 - DNA, 20 bp, Artificial sequence
  Synthetic oligonucleotide
tggtagaggctcagtaaccc

SEQ ID NO: 2462 - DNA, 20 bp, Artificial sequence
  Synthetic oligonucleotide
tctacgggcactatgtttgg

SEQ ID NO: 2463 - DNA, 20 bp, Artificial sequence
  Synthetic oligonucleotide
cacactacatataagctctg

SEQ ID NO: 2464 - DNA, 20 bp, Artificial sequence
  Synthetic oligonucleotide
ttttctgcctccaggctctg

SEQ ID NO: 2465 - DNA, 20 bp, Artificial sequence
  Synthetic oligonucleotide
cttctgccactcacactcct

SEQ ID NO: 2466 - DNA, 20 bp, Artificial sequence
  Synthetic oligonucleotide
gtcagtggcacaatcccggg

SEQ ID NO: 2467 - DNA, 20 bp, Artificial sequence
  Synthetic oligonucleotide
gcaagcgaatgaatgaacag

SEQ ID NO: 2468 - DNA, 20 bp, Artificial sequence
  Synthetic oligonucleotide
atcagggaggtgagcagcac

SEQ ID NO: 2469 - DNA, 20 bp, Artificial sequence
  Synthetic oligonucleotide
ggtggccgtccctgctccgc

SEQ ID NO: 2470 - DNA, 20 bp, Artificial sequence
  Synthetic oligonucleotide
tgatgagggctcaccggttc

SEQ ID NO: 2471 - DNA, 20 bp, Artificial sequence
  Synthetic oligonucleotide
gctatgtgtgaggcaggcac

SEQ ID NO: 2472 - DNA, 20 bp, Artificial sequence
  Synthetic oligonucleotide
acccaagtccttggccttga

SEQ ID NO: 2473 - DNA, 20 bp, Artificial sequence
  Synthetic oligonucleotide
cagaagagatgggtgaggtg

SEQ ID NO: 2474 - DNA, 20 bp, Artificial sequence
  Synthetic oligonucleotide
atctcctagctttttcccca

SEQ ID NO: 2475 - DNA, 20 bp, Artificial sequence
  Synthetic oligonucleotide
agagagaaaaatataacacg

SEQ ID NO: 2476 - DNA, 20 bp, Artificial sequence
  Synthetic oligonucleotide
tcagggccaatgcaagtaaa

SEQ ID NO: 2477 - DNA, 20 bp, Artificial sequence
  Synthetic oligonucleotide
agaagaggaattttgttcct

SEQ ID NO: 2478 - DNA, 20 bp, Artificial sequence
  Synthetic oligonucleotide
aagtcctgagacatgcatat

SEQ ID NO: 2479 - DNA, 20 bp, Artificial sequence
  Synthetic oligonucleotide
ctactagtcagcctggttag

SEQ ID NO: 2480 - DNA, 20 bp, Artificial sequence
  Synthetic oligonucleotide
tgactatctaggatttggca

SEQ ID NO: 2481 - DNA, 20 bp, Artificial sequence
  Synthetic oligonucleotide
atctgtgctttagtgacctg

SEQ ID NO: 2482 - DNA, 20 bp, Artificial sequence
  Synthetic oligonucleotide
ttagtgctcaatacacatag

SEQ ID NO: 2483 - DNA, 20 bp, Artificial sequence
  Synthetic oligonucleotide
gagacaattaactaaaataa

SEQ ID NO: 2484 - DNA, 20 bp, Artificial sequence
  Synthetic oligonucleotide
agactccgtcgaaagcaggc

SEQ ID NO: 2485 - DNA, 20 bp, Artificial sequence
  Synthetic oligonucleotide
tctgaaaacccagcacggta

SEQ ID NO: 2486 - DNA, 20 bp, Artificial sequence
  Synthetic oligonucleotide
gctcttccaaacgggctgga

SEQ ID NO: 2487 - DNA, 20 bp, Artificial sequence
  Synthetic oligonucleotide
cagggcatgagccatcctct

SEQ ID NO: 2488 - DNA, 20 bp, Artificial sequence
  Synthetic oligonucleotide
ctcctccagaattccctggg

SEQ ID NO: 2489 - DNA, 20 bp, Artificial sequence
  Synthetic oligonucleotide
tttggtaccaaggctcccct

SEQ ID NO: 2490 - DNA, 20 bp, Artificial sequence
  Synthetic oligonucleotide
tttgagggtgagaaagagag

SEQ ID NO: 2491 - DNA, 20 bp, Artificial sequence
  Synthetic oligonucleotide
cccaactgtgtctgctagag

SEQ ID NO: 2492 - DNA, 20 bp, Artificial sequence
  Synthetic oligonucleotide
aagatgagctcccactgtgg

SEQ ID NO: 2493 - DNA, 20 bp, Artificial sequence
  Synthetic oligonucleotide
gtggtgagataacactggga

SEQ ID NO: 2494 - DNA, 20 bp, Artificial sequence
  Synthetic oligonucleotide
aggagttcacacagacccca

SEQ ID NO: 2495 - DNA, 20 bp, Artificial sequence
  Synthetic oligonucleotide
attgagtgccccagccaggg

SEQ ID NO: 2496 - DNA, 20 bp, Artificial sequence
  Synthetic oligonucleotide
tctcaacctccagccgggcg

SEQ ID NO: 2497 - DNA, 20 bp, Artificial sequence
  Synthetic oligonucleotide
gctcctggagttcccgaacc

SEQ ID NO: 2498 - DNA, 20 bp, Artificial sequence
  Synthetic oligonucleotide
ccgcgcagagactccaggtc

SEQ ID NO: 2499 - DNA, 20 bp, Artificial sequence
  Synthetic oligonucleotide
ctccttaatgacctctccat

SEQ ID NO: 2500 - DNA, 20 bp, Artificial sequence
  Synthetic oligonucleotide
aggcggagcaactatcctgc

SEQ ID NO: 2501 - DNA, 20 bp, Artificial sequence
  Synthetic oligonucleotide
gtgagtttcttgttagttgg

SEQ ID NO: 2502 - DNA, 20 bp, Artificial sequence
  Synthetic oligonucleotide
cataacaacaggaatcaggg

SEQ ID NO: 2503 - DNA, 20 bp, Artificial sequence
  Synthetic oligonucleotide
aagcctctggccagggctac

SEQ ID NO: 2504 - DNA, 20 bp, Artificial sequence
  Synthetic oligonucleotide
gatatcccacctcataaaaa

SEQ ID NO: 2505 - DNA, 20 bp, Artificial sequence
  Synthetic oligonucleotide
gatcagggtcagtctaggag

SEQ ID NO: 2506 - DNA, 20 bp, Artificial sequence
  Synthetic oligonucleotide
acaacagatcccccaagtgc

SEQ ID NO: 2507 - DNA, 20 bp, Artificial sequence
  Synthetic oligonucleotide
cccacaatccagaggccaag

SEQ ID NO: 2508 - DNA, 20 bp, Artificial sequence
  Synthetic oligonucleotide
tttctctcctgtttcagcat

SEQ ID NO: 2509 - DNA, 20 bp, Artificial sequence
  Synthetic oligonucleotide
agaaatgggacaaagtcatg

SEQ ID NO: 2510 - DNA, 20 bp, Artificial sequence
  Synthetic oligonucleotide
cccttggcttagggaaaagc

SEQ ID NO: 2511 - DNA, 20 bp, Artificial sequence
  Synthetic oligonucleotide
aatagggcactacctagaat

SEQ ID NO: 2512 - DNA, 20 bp, Artificial sequence
  Synthetic oligonucleotide
gtgtcagccctgagcacccg

SEQ ID NO: 2513 - DNA, 20 bp, Artificial sequence
  Synthetic oligonucleotide
cagcgactaaaggcagcagc

SEQ ID NO: 2514 - DNA, 20 bp, Artificial sequence
  Synthetic oligonucleotide
gaccttgtgattttccccgt

SEQ ID NO: 2515 - DNA, 20 bp, Artificial sequence
  Synthetic oligonucleotide
cactccctgtcaagctgggc

SEQ ID NO: 2516 - DNA, 20 bp, Artificial sequence
  Synthetic oligonucleotide
taatgtacagttactctgta

SEQ ID NO: 2517 - DNA, 20 bp, Artificial sequence
  Synthetic oligonucleotide
cctcagggatgaaagaataa

SEQ ID NO: 2518 - DNA, 20 bp, Artificial sequence
  Synthetic oligonucleotide
gggaagaatcctctgaactg

SEQ ID NO: 2519 - DNA, 20 bp, Artificial sequence
  Synthetic oligonucleotide
gcagggaacataaaacttta

SEQ ID NO: 2520 - DNA, 20 bp, Artificial sequence
  Synthetic oligonucleotide
ctggagcaacctacaggccc

SEQ ID NO: 2521 - DNA, 20 bp, Artificial sequence
  Synthetic oligonucleotide
gccccacctagaagtaccct

SEQ ID NO: 2522 - DNA, 20 bp, Artificial sequence
  Synthetic oligonucleotide
tttggtgcttttgccccctg

SEQ ID NO: 2523 - DNA, 20 bp, Artificial sequence
  Synthetic oligonucleotide
cggcccctccctgagacttc

SEQ ID NO: 2524 - DNA, 20 bp, Artificial sequence
  Synthetic oligonucleotide
cctgcactgctttccccagt

SEQ ID NO: 2525 - DNA, 20 bp, Artificial sequence
  Synthetic oligonucleotide
gctctttccctcactttctt

SEQ ID NO: 2526 - DNA, 20 bp, Artificial sequence
  Synthetic oligonucleotide
tgaccaccgcttcacagctg

SEQ ID NO: 2527 - DNA, 20 bp, Artificial sequence
  Synthetic oligonucleotide
cgcacatgtcctcctgcact

SEQ ID NO: 2528 - DNA, 20 bp, Artificial sequence
  Synthetic oligonucleotide
gacagaggacttgtctggag

SEQ ID NO: 2529 - DNA, 20 bp, Artificial sequence
  Synthetic oligonucleotide
cacctccctgacctgtctat

SEQ ID NO: 2530 - DNA, 20 bp, Artificial sequence
  Synthetic oligonucleotide
ggcttcatctgcttcctgga

SEQ ID NO: 2531 - DNA, 20 bp, Artificial sequence
  Synthetic oligonucleotide
cctgtctctacctgccaatc

SEQ ID NO: 2532 - DNA, 20 bp, Artificial sequence
  Synthetic oligonucleotide
caggagttcgaatgctctct

SEQ ID NO: 2533 - DNA, 20 bp, Artificial sequence
  Synthetic oligonucleotide
cctcctgaccagggtgagag

SEQ ID NO: 2534 - DNA, 20 bp, Artificial sequence
  Synthetic oligonucleotide
ctggtgaaagtcagtcacct

SEQ ID NO: 2535 - DNA, 20 bp, Artificial sequence
  Synthetic oligonucleotide
agcagtaataataatgggta

SEQ ID NO: 2536 - DNA, 20 bp, Artificial sequence
  Synthetic oligonucleotide
cacagggcttagaacagaac

SEQ ID NO: 2537 - DNA, 20 bp, Artificial sequence
  Synthetic oligonucleotide
tctctcatctgtcaaagaac

SEQ ID NO: 2538 - DNA, 20 bp, Artificial sequence
  Synthetic oligonucleotide
atggtagaggctcagtaacc

SEQ ID NO: 2539 - DNA, 20 bp, Artificial sequence
  Synthetic oligonucleotide
ctctacgggcactatgtttg

SEQ ID NO: 2540 - DNA, 20 bp, Artificial sequence
  Synthetic oligonucleotide
tggctcccacactacatata

SEQ ID NO: 2541 - DNA, 20 bp, Artificial sequence
  Synthetic oligonucleotide
tgcttttctgcctccaggct

SEQ ID NO: 2542 - DNA, 20 bp, Artificial sequence
  Synthetic oligonucleotide
ccagtggcttctgccactca

SEQ ID NO: 2543 - DNA, 20 bp, Artificial sequence
  Synthetic oligonucleotide
agcggaggcctgggtgtttt

SEQ ID NO: 2544 - DNA, 20 bp, Artificial sequence
  Synthetic oligonucleotide
agcaagcgaatgaatgaaca

SEQ ID NO: 2545 - DNA, 20 bp, Artificial sequence
  Synthetic oligonucleotide
aatcagggaggtgagcagca

SEQ ID NO: 2546 - DNA, 20 bp, Artificial sequence
  Synthetic oligonucleotide
cccttctcccctggcatctc

SEQ ID NO: 2547 - DNA, 20 bp, Artificial sequence
  Synthetic oligonucleotide
gtgaggcagcagggagactt

SEQ ID NO: 2548 - DNA, 20 bp, Artificial sequence
  Synthetic oligonucleotide
gactgcctgctatgtgtgag

SEQ ID NO: 2549 - DNA, 20 bp, Artificial sequence
  Synthetic oligonucleotide
tgacccaagtccttggcctt

SEQ ID NO: 2550 - DNA, 20 bp, Artificial sequence
  Synthetic oligonucleotide
ggcagaagagatgggtgagg

SEQ ID NO: 2551 - DNA, 20 bp, Artificial sequence
  Synthetic oligonucleotide
actccatctcctagcttttt

SEQ ID NO: 2552 - DNA, 20 bp, Artificial sequence
  Synthetic oligonucleotide
cgagagagaaaaatataaca

SEQ ID NO: 2553 - DNA, 20 bp, Artificial sequence
  Synthetic oligonucleotide
tttcagggccaatgcaagta

SEQ ID NO: 2554 - DNA, 20 bp, Artificial sequence
  Synthetic oligonucleotide
tctagtccagaagaagagga

SEQ ID NO: 2555 - DNA, 20 bp, Artificial sequence
  Synthetic oligonucleotide
atgctgaattaagtcctgag

SEQ ID NO: 2556 - DNA, 20 bp, Artificial sequence
  Synthetic oligonucleotide
tctactagtcagcctggtta

SEQ ID NO: 2557 - DNA, 20 bp, Artificial sequence
  Synthetic oligonucleotide
tgtgactatctaggatttgg

SEQ ID NO: 2558 - DNA, 20 bp, Artificial sequence
  Synthetic oligonucleotide
tatctgtgctttagtgacct

SEQ ID NO: 2559 - DNA, 20 bp, Artificial sequence
  Synthetic oligonucleotide
attagtgctcaatacacata

SEQ ID NO: 2560 - DNA, 20 bp, Artificial sequence
  Synthetic oligonucleotide
ggagacaattaactaaaata

SEQ ID NO: 2561 - DNA, 20 bp, Artificial sequence
  Synthetic oligonucleotide
taagactccgtcgaaagcag

SEQ ID NO: 2562 - DNA, 20 bp, Artificial sequence
  Synthetic oligonucleotide
ttctgaaaacccagcacggt

SEQ ID NO: 2563 - DNA, 20 bp, Artificial sequence
  Synthetic oligonucleotide
gagagagcctaggctcttcc

SEQ ID NO: 2564 - DNA, 20 bp, Artificial sequence
  Synthetic oligonucleotide
tcagggcatgagccatcctc

SEQ ID NO: 2565 - DNA, 20 bp, Artificial sequence
  Synthetic oligonucleotide
ttccttgctctcctccagaa

SEQ ID NO: 2566 - DNA, 20 bp, Artificial sequence
  Synthetic oligonucleotide
tcccatctagtggctttggt

SEQ ID NO: 2567 - DNA, 20 bp, Artificial sequence
  Synthetic oligonucleotide
tctctttctctccctggcaa

SEQ ID NO: 2568 - DNA, 20 bp, Artificial sequence
  Synthetic oligonucleotide
ccatccccaactgtgtctgc

SEQ ID NO: 2569 - DNA, 20 bp, Artificial sequence
  Synthetic oligonucleotide
ctgctggagtaagatgagct

SEQ ID NO: 2570 - DNA, 20 bp, Artificial sequence
  Synthetic oligonucleotide
ttcttgatagtaaccacagc

SEQ ID NO: 2571 - DNA, 20 bp, Artificial sequence
  Synthetic oligonucleotide
taggagttcacacagacccc

SEQ ID NO: 2572 - DNA, 20 bp, Artificial sequence
  Synthetic oligonucleotide
gaagccagcattgagtgccc

SEQ ID NO: 2573 - DNA, 20 bp, Artificial sequence
  Synthetic oligonucleotide
tgtgccagattgtccctctc

SEQ ID NO: 2574 - DNA, 20 bp, Artificial sequence
  Synthetic oligonucleotide
cacatggacctgctgtcggg

SEQ ID NO: 2575 - DNA, 20 bp, Artificial sequence
  Synthetic oligonucleotide
tgccgcgcagagactccagg

SEQ ID NO: 2576 - DNA, 20 bp, Artificial sequence
  Synthetic oligonucleotide
actccttaatgacctctcca

SEQ ID NO: 2577 - DNA, 20 bp, Artificial sequence
  Synthetic oligonucleotide
gaaatgtgccagcagaggcg

SEQ ID NO: 2578 - DNA, 20 bp, Artificial sequence
  Synthetic oligonucleotide
gggtgagtttcttgttagtt

SEQ ID NO: 2579 - DNA, 20 bp, Artificial sequence
  Synthetic oligonucleotide
agtttccataacaacaggaa

SEQ ID NO: 2580 - DNA, 20 bp, Artificial sequence
  Synthetic oligonucleotide
aaaacaagcctctggccagg

SEQ ID NO: 2581 - DNA, 20 bp, Artificial sequence
  Synthetic oligonucleotide
ggatatcccacctcataaaa

SEQ ID NO: 2582 - DNA, 20 bp, Artificial sequence
  Synthetic oligonucleotide
cacccatcttagactgatca

SEQ ID NO: 2583 - DNA, 20 bp, Artificial sequence
  Synthetic oligonucleotide
cacaacagatcccccaagtg

SEQ ID NO: 2584 - DNA, 20 bp, Artificial sequence
  Synthetic oligonucleotide
aattcccacaatccagaggc

SEQ ID NO: 2585 - DNA, 20 bp, Artificial sequence
  Synthetic oligonucleotide
ctttctctcctgtttcagca

SEQ ID NO: 2586 - DNA, 20 bp, Artificial sequence
  Synthetic oligonucleotide
aggcctttagaaatgggaca

SEQ ID NO: 2587 - DNA, 20 bp, Artificial sequence
  Synthetic oligonucleotide
ggaccgcaagaggcccttgg

SEQ ID NO: 2588 - DNA, 20 bp, Artificial sequence
  Synthetic oligonucleotide
aaatagggcactacctagaa

SEQ ID NO: 2589 - DNA, 20 bp, Artificial sequence
  Synthetic oligonucleotide
ctgctcagtcaaagcagagt

SEQ ID NO: 2590 - DNA, 20 bp, Artificial sequence
  Synthetic oligonucleotide
tcttgtgaccttgtgatttt

SEQ ID NO: 2591 - DNA, 20 bp, Artificial sequence
  Synthetic oligonucleotide
tcactccctgtcaagctggg

SEQ ID NO: 2592 - DNA, 20 bp, Artificial sequence
  Synthetic oligonucleotide
ttaatgtacagttactctgt

SEQ ID NO: 2593 - DNA, 20 bp, Artificial sequence
  Synthetic oligonucleotide
cgatggagcctcagggatga

SEQ ID NO: 2594 - DNA, 20 bp, Artificial sequence
  Synthetic oligonucleotide
agggaagaatcctctgaact

SEQ ID NO: 2595 - DNA, 20 bp, Artificial sequence
  Synthetic oligonucleotide
agcagggaacataaaacttt

SEQ ID NO: 2596 - DNA, 20 bp, Artificial sequence
  Synthetic oligonucleotide
tgatcctcagtcccagtctg

SEQ ID NO: 2597 - DNA, 20 bp, Artificial sequence
  Synthetic oligonucleotide
aagccccacctagaagtacc

SEQ ID NO: 2598 - DNA, 20 bp, Artificial sequence
  Synthetic oligonucleotide
cctcctcacttctgcctcac

SEQ ID NO: 2599 - DNA, 20 bp, Artificial sequence
  Synthetic oligonucleotide
tcggcccctccctgagactt

SEQ ID NO: 2600 - DNA, 20 bp, Artificial sequence
  Synthetic oligonucleotide
tcctgcactgctttccccag

SEQ ID NO: 2601 - DNA, 20 bp, Artificial sequence
  Synthetic oligonucleotide
tgctctttccctcactttct

SEQ ID NO: 2602 - DNA, 20 bp, Artificial sequence
  Synthetic oligonucleotide
attatgaccaccgcttcaca

SEQ ID NO: 2603 - DNA, 20 bp, Artificial sequence
  Synthetic oligonucleotide
acacacgcacatgtcctcct

SEQ ID NO: 2604 - DNA, 20 bp, Artificial sequence
  Synthetic oligonucleotide
ccttagacagaggacttgtc

SEQ ID NO: 2605 - DNA, 20 bp, Artificial sequence
  Synthetic oligonucleotide
ccacctccctgacctgtcta

SEQ ID NO: 2606 - DNA, 20 bp, Artificial sequence
  Synthetic oligonucleotide
agttgcaatctctgtgttga

SEQ ID NO: 2607 - DNA, 20 bp, Artificial sequence
  Synthetic oligonucleotide
tcctgtctctacctgccaat

SEQ ID NO: 2608 - DNA, 20 bp, Artificial sequence
  Synthetic oligonucleotide
ccaggagttcgaatgctctc

SEQ ID NO: 2609 - DNA, 20 bp, Artificial sequence
  Synthetic oligonucleotide
aacctcctgaccagggtgag

SEQ ID NO: 2610 - DNA, 20 bp, Artificial sequence
  Synthetic oligonucleotide
tctggtgaaagtcagtcacc

SEQ ID NO: 2611 - DNA, 20 bp, Artificial sequence
  Synthetic oligonucleotide
tagcagtaataataatgggt

SEQ ID NO: 2612 - DNA, 20 bp, Artificial sequence
  Synthetic oligonucleotide
tgaaaagcacagggcttaga

SEQ ID NO: 2613 - DNA, 20 bp, Artificial sequence
  Synthetic oligonucleotide
ctctctcatctgtcaaagaa

SEQ ID NO: 2614 - DNA, 20 bp, Artificial sequence
  Synthetic oligonucleotide
atatggtagaggctcagtaa

SEQ ID NO: 2615 - DNA, 20 bp, Artificial sequence
  Synthetic oligonucleotide
ggtgttctctacgggcacta

SEQ ID NO: 2616 - DNA, 20 bp, Artificial sequence
  Synthetic oligonucleotide
tcctggctcccacactacat

SEQ ID NO: 2617 - DNA, 20 bp, Artificial sequence
  Synthetic oligonucleotide
gtgcttttctgcctccaggc

SEQ ID NO: 2618 - DNA, 20 bp, Artificial sequence
  Synthetic oligonucleotide
ccctgctcagacaccagtgg

SEQ ID NO: 2619 - DNA, 20 bp, Artificial sequence
  Synthetic oligonucleotide
gagcggaggcctgggtgttt

SEQ ID NO: 2620 - DNA, 20 bp, Artificial sequence
  Synthetic oligonucleotide
tagcacaacacctggtcagc

SEQ ID NO: 2621 - DNA, 20 bp, Artificial sequence
  Synthetic oligonucleotide
ggaaatcagggaggtgagca

SEQ ID NO: 2622 - DNA, 20 bp, Artificial sequence
  Synthetic oligonucleotide
gcccttctcccctggcatct

SEQ ID NO: 2623 - DNA, 20 bp, Artificial sequence
  Synthetic oligonucleotide
ctctaccgtgaggcagcagg

SEQ ID NO: 2624 - DNA, 20 bp, Artificial sequence
  Synthetic oligonucleotide
ctagtgactgcctgctatgt

SEQ ID NO: 2625 - DNA, 20 bp, Artificial sequence
  Synthetic oligonucleotide
gggagtatgcctcttagttt

SEQ ID NO: 2626 - DNA, 20 bp, Artificial sequence
  Synthetic oligonucleotide
agaaagttccaaggaggcag

SEQ ID NO: 2627 - DNA, 20 bp, Artificial sequence
  Synthetic oligonucleotide
aactccatctcctagctttt

SEQ ID NO: 2628 - DNA, 20 bp, Artificial sequence
  Synthetic oligonucleotide
ccgagagagaaaaatataac

SEQ ID NO: 2629 - DNA, 20 bp, Artificial sequence
  Synthetic oligonucleotide
atttcagggccaatgcaagt

SEQ ID NO: 2630 - DNA, 20 bp, Artificial sequence
  Synthetic oligonucleotide
ttctagtccagaagaagagg

SEQ ID NO: 2631 - DNA, 20 bp, Artificial sequence
  Synthetic oligonucleotide
gatgctgaattaagtcctga

SEQ ID NO: 2632 - DNA, 20 bp, Artificial sequence
  Synthetic oligonucleotide
tacctctactagtcagcctg

SEQ ID NO: 2633 - DNA, 20 bp, Artificial sequence
  Synthetic oligonucleotide
ctgtgactatctaggatttg

SEQ ID NO: 2634 - DNA, 20 bp, Artificial sequence
  Synthetic oligonucleotide
ttatctgtgctttagtgacc

SEQ ID NO: 2635 - DNA, 20 bp, Artificial sequence
  Synthetic oligonucleotide
catattagtgctcaatacac

SEQ ID NO: 2636 - DNA, 20 bp, Artificial sequence
  Synthetic oligonucleotide
acttctctaggtgggagaga

SEQ ID NO: 2637 - DNA, 20 bp, Artificial sequence
  Synthetic oligonucleotide
gtaagactccgtcgaaagca

SEQ ID NO: 2638 - DNA, 20 bp, Artificial sequence
  Synthetic oligonucleotide
tttctgaaaacccagcacgg

SEQ ID NO: 2639 - DNA, 20 bp, Artificial sequence
  Synthetic oligonucleotide
tgagaacctatgcaaccgag

SEQ ID NO: 2640 - DNA, 20 bp, Artificial sequence
  Synthetic oligonucleotide
tttcagggcatgagccatcc

SEQ ID NO: 2641 - DNA, 20 bp, Artificial sequence
  Synthetic oligonucleotide
tcagtttccttgctctcctc

SEQ ID NO: 2642 - DNA, 20 bp, Artificial sequence
  Synthetic oligonucleotide
gatcccatctagtggctttg

SEQ ID NO: 2643 - DNA, 20 bp, Artificial sequence
  Synthetic oligonucleotide
ttctctttctctccctggca

SEQ ID NO: 2644 - DNA, 20 bp, Artificial sequence
  Synthetic oligonucleotide
cccatccccaactgtgtctg

SEQ ID NO: 2645 - DNA, 20 bp, Artificial sequence
  Synthetic oligonucleotide
aagctgctggagtaagatga

SEQ ID NO: 2646 - DNA, 20 bp, Artificial sequence
  Synthetic oligonucleotide
tacttttcttgatagtaacc

SEQ ID NO: 2647 - DNA, 20 bp, Artificial sequence
  Synthetic oligonucleotide
ttaggagttcacacagaccc

SEQ ID NO: 2648 - DNA, 20 bp, Artificial sequence
  Synthetic oligonucleotide
ctcactggcccgggtctcct

SEQ ID NO: 2649 - DNA, 20 bp, Artificial sequence
  Synthetic oligonucleotide
ctgtgccagattgtccctct

SEQ ID NO: 2650 - DNA, 20 bp, Artificial sequence
  Synthetic oligonucleotide
ccacatggacctgctgtcgg

SEQ ID NO: 2651 - DNA, 20 bp, Artificial sequence
  Synthetic oligonucleotide
ttcctccagccgcgccagcg

SEQ ID NO: 2652 - DNA, 20 bp, Artificial sequence
  Synthetic oligonucleotide
tgcttggactccttaatgac

SEQ ID NO: 2653 - DNA, 20 bp, Artificial sequence
  Synthetic oligonucleotide
gggaaatgtgccagcagagg

SEQ ID NO: 2654 - DNA, 20 bp, Artificial sequence
  Synthetic oligonucleotide
ccctccagactgccccttgg

SEQ ID NO: 2655 - DNA, 20 bp, Artificial sequence
  Synthetic oligonucleotide
ccatctctggcaacagtttc

SEQ ID NO: 2656 - DNA, 20 bp, Artificial sequence
  Synthetic oligonucleotide
aagacaaaacaagcctctgg

SEQ ID NO: 2657 - DNA, 20 bp, Artificial sequence
  Synthetic oligonucleotide
gggatatcccacctcataaa

SEQ ID NO: 2658 - DNA, 20 bp, Artificial sequence
  Synthetic oligonucleotide
ccacccatcttagactgatc

SEQ ID NO: 2659 - DNA, 20 bp, Artificial sequence
  Synthetic oligonucleotide
acacaacagatcccccaagt

SEQ ID NO: 2660 - DNA, 20 bp, Artificial sequence
  Synthetic oligonucleotide
taattcccacaatccagagg

SEQ ID NO: 2661 - DNA, 20 bp, Artificial sequence
  Synthetic oligonucleotide
tcccctttctctcctgtttc

SEQ ID NO: 2662 - DNA, 20 bp, Artificial sequence
  Synthetic oligonucleotide
agaggcctttagaaatggga

SEQ ID NO: 2663 - DNA, 20 bp, Artificial sequence
  Synthetic oligonucleotide
aagaagggaccgcaagaggc

SEQ ID NO: 2664 - DNA, 20 bp, Artificial sequence
  Synthetic oligonucleotide
caattgtaaaatagggcact

SEQ ID NO: 2665 - DNA, 20 bp, Artificial sequence
  Synthetic oligonucleotide
cagtctgctcagtcaaagca

SEQ ID NO: 2666 - DNA, 20 bp, Artificial sequence
  Synthetic oligonucleotide
atcttgtgaccttgtgattt

SEQ ID NO: 2667 - DNA, 20 bp, Artificial sequence
  Synthetic oligonucleotide
ctcactccctgtcaagctgg

SEQ ID NO: 2668 - DNA, 20 bp, Artificial sequence
  Synthetic oligonucleotide
cagtttaatgtacagttact

SEQ ID NO: 2669 - DNA, 20 bp, Artificial sequence
  Synthetic oligonucleotide
gcgatggagcctcagggatg

SEQ ID NO: 2670 - DNA, 20 bp, Artificial sequence
  Synthetic oligonucleotide
gagggaagaatcctctgaac

SEQ ID NO: 2671 - DNA, 20 bp, Artificial sequence
  Synthetic oligonucleotide
cattaagagcagggaacata

SEQ ID NO: 2672 - DNA, 20 bp, Artificial sequence
  Synthetic oligonucleotide
gaaggcccccagggagagct

SEQ ID NO: 2673 - DNA, 20 bp, Artificial sequence
  Synthetic oligonucleotide
caagccccacctagaagtac

SEQ ID NO: 2674 - DNA, 20 bp, Artificial sequence
  Synthetic oligonucleotide
ccctcctcacttctgcctca

SEQ ID NO: 2675 - DNA, 20 bp, Artificial sequence
  Synthetic oligonucleotide
ttcggcccctccctgagact

SEQ ID NO: 2676 - DNA, 20 bp, Artificial sequence
  Synthetic oligonucleotide
ccgctgctcctgcactgctt

SEQ ID NO: 2677 - DNA, 20 bp, Artificial sequence
  Synthetic oligonucleotide
cctgctctttccctcacttt

SEQ ID NO: 2678 - DNA, 20 bp, Artificial sequence
  Synthetic oligonucleotide
tattatgaccaccgcttcac

SEQ ID NO: 2679 - DNA, 20 bp, Artificial sequence
  Synthetic oligonucleotide
cacacacgcacatgtcctcc

SEQ ID NO: 2680 - DNA, 20 bp, Artificial sequence
  Synthetic oligonucleotide
gggccttagacagaggactt

SEQ ID NO: 2681 - DNA, 20 bp, Artificial sequence
  Synthetic oligonucleotide
cctccacctccctgacctgt

SEQ ID NO: 2682 - DNA, 20 bp, Artificial sequence
  Synthetic oligonucleotide
cagttgcaatctctgtgttg

SEQ ID NO: 2683 - DNA, 20 bp, Artificial sequence
  Synthetic oligonucleotide
ttcctgtctctacctgccaa

SEQ ID NO: 2684 - DNA, 20 bp, Artificial sequence
  Synthetic oligonucleotide
cttctgcctgcccctcggcc

SEQ ID NO: 2685 - DNA, 20 bp, Artificial sequence
  Synthetic oligonucleotide
gaacctcctgaccagggtga

SEQ ID NO: 2686 - DNA, 20 bp, Artificial sequence
  Synthetic oligonucleotide
ctctggtgaaagtcagtcac

SEQ ID NO: 2687 - DNA, 20 bp, Artificial sequence
  Synthetic oligonucleotide
gtagcagtaataataatggg

SEQ ID NO: 2688 - DNA, 20 bp, Artificial sequence
  Synthetic oligonucleotide
catgaaaagcacagggctta

SEQ ID NO: 2689 - DNA, 20 bp, Artificial sequence
  Synthetic oligonucleotide
gctctctcatctgtcaaaga

SEQ ID NO: 2690 - DNA, 20 bp, Artificial sequence
  Synthetic oligonucleotide
agacacctctctgtgtcctg

SEQ ID NO: 2691 - DNA, 20 bp, Artificial sequence
  Synthetic oligonucleotide
gtggtgttctctacgggcac

SEQ ID NO: 2692 - DNA, 20 bp, Artificial sequence
  Synthetic oligonucleotide
gccccctctacagtgtcttt

SEQ ID NO: 2693 - DNA, 20 bp, Artificial sequence
  Synthetic oligonucleotide
tctgtgcttttctgcctcca

SEQ ID NO: 2694 - DNA, 20 bp, Artificial sequence
  Synthetic oligonucleotide
ctcaccctgctcagacacca

SEQ ID NO: 2695 - DNA, 20 bp, Artificial sequence
  Synthetic oligonucleotide
cgagcggaggcctgggtgtt

SEQ ID NO: 2696 - DNA, 20 bp, Artificial sequence
  Synthetic oligonucleotide
ctagcacaacacctggtcag

SEQ ID NO: 2697 - DNA, 20 bp, Artificial sequence
  Synthetic oligonucleotide
aggtctgcaaactaggtggg

SEQ ID NO: 2698 - DNA, 20 bp, Artificial sequence
  Synthetic oligonucleotide
cccgccctcgacccaggtcc

SEQ ID NO: 2699 - DNA, 20 bp, Artificial sequence
  Synthetic oligonucleotide
gagctctaccgtgaggcagc

SEQ ID NO: 2700 - DNA, 20 bp, Artificial sequence
  Synthetic oligonucleotide
atctagtgactgcctgctat

SEQ ID NO: 2701 - DNA, 20 bp, Artificial sequence
  Synthetic oligonucleotide
agtccaatcttggctgggaa

SEQ ID NO: 2702 - DNA, 20 bp, Artificial sequence
  Synthetic oligonucleotide
gaagaaagttccaaggaggc

SEQ ID NO: 2703 - DNA, 20 bp, Artificial sequence
  Synthetic oligonucleotide
taactccatctcctagcttt

SEQ ID NO: 2704 - DNA, 20 bp, Artificial sequence
  Synthetic oligonucleotide
cccgagagagaaaaatataa

SEQ ID NO: 2705 - DNA, 20 bp, Artificial sequence
  Synthetic oligonucleotide
tcatttcagggccaatgcaa

SEQ ID NO: 2706 - DNA, 20 bp, Artificial sequence
  Synthetic oligonucleotide
tattctagtccagaagaaga

SEQ ID NO: 2707 - DNA, 20 bp, Artificial sequence
  Synthetic oligonucleotide
agcctttctgatgctgaatt

SEQ ID NO: 2708 - DNA, 20 bp, Artificial sequence
  Synthetic oligonucleotide
ttacctctactagtcagcct

SEQ ID NO: 2709 - DNA, 20 bp, Artificial sequence
  Synthetic oligonucleotide
cctgtgactatctaggattt

SEQ ID NO: 2710 - DNA, 20 bp, Artificial sequence
  Synthetic oligonucleotide
tttatctgtgctttagtgac

SEQ ID NO: 2711 - DNA, 20 bp, Artificial sequence
  Synthetic oligonucleotide
catgtggcacatattagtgc

SEQ ID NO: 2712 - DNA, 20 bp, Artificial sequence
  Synthetic oligonucleotide
tacttctctaggtgggagag

SEQ ID NO: 2713 - DNA, 20 bp, Artificial sequence
  Synthetic oligonucleotide
agtaagactccgtcgaaagc

SEQ ID NO: 2714 - DNA, 20 bp, Artificial sequence
  Synthetic oligonucleotide
ctttctgaaaacccagcacg

SEQ ID NO: 2715 - DNA, 20 bp, Artificial sequence
  Synthetic oligonucleotide
atgagaacctatgcaaccga

SEQ ID NO: 2716 - DNA, 20 bp, Artificial sequence
  Synthetic oligonucleotide
ctcatggactttcagggcat

SEQ ID NO: 2717 - DNA, 20 bp, Artificial sequence
  Synthetic oligonucleotide
ttacattcagtttccttgct

SEQ ID NO: 2718 - DNA, 20 bp, Artificial sequence
  Synthetic oligonucleotide
ggatcccatctagtggcttt

SEQ ID NO: 2719 - DNA, 20 bp, Artificial sequence
  Synthetic oligonucleotide
taactttaattctctttctc

SEQ ID NO: 2720 - DNA, 20 bp, Artificial sequence
  Synthetic oligonucleotide
ccccatccccaactgtgtct

SEQ ID NO: 2721 - DNA, 20 bp, Artificial sequence
  Synthetic oligonucleotide
taagctgctggagtaagatg

SEQ ID NO: 2722 - DNA, 20 bp, Artificial sequence
  Synthetic oligonucleotide
ttacttttcttgatagtaac

SEQ ID NO: 2723 - DNA, 20 bp, Artificial sequence
  Synthetic oligonucleotide
gcacagtgcaacagttagga

SEQ ID NO: 2724 - DNA, 20 bp, Artificial sequence
  Synthetic oligonucleotide
ctgcccgctcactggcccgg

SEQ ID NO: 2725 - DNA, 20 bp, Artificial sequence
  Synthetic oligonucleotide
tgcctcacagtggccaggtc

SEQ ID NO: 2726 - DNA, 20 bp, Artificial sequence
  Synthetic oligonucleotide
ctttcagggctgcggtgagg

SEQ ID NO: 2727 - DNA, 20 bp, Artificial sequence
  Synthetic oligonucleotide
tcttcctccagccgcgccag

SEQ ID NO: 2728 - DNA, 20 bp, Artificial sequence
  Synthetic oligonucleotide
ctgcttggactccttaatga

SEQ ID NO: 2729 - DNA, 20 bp, Artificial sequence
  Synthetic oligonucleotide
aagctgacctagggacagag

SEQ ID NO: 2730 - DNA, 20 bp, Artificial sequence
  Synthetic oligonucleotide
cccctccagactgccccttg

SEQ ID NO: 2731 - DNA, 20 bp, Artificial sequence
  Synthetic oligonucleotide
tccatctctggcaacagttt

SEQ ID NO: 2732 - DNA, 20 bp, Artificial sequence
  Synthetic oligonucleotide
aaagacaaaacaagcctctg

SEQ ID NO: 2733 - DNA, 20 bp, Artificial sequence
  Synthetic oligonucleotide
agggatatcccacctcataa

SEQ ID NO: 2734 - DNA, 20 bp, Artificial sequence
  Synthetic oligonucleotide
tgactgccccaggtggcagg

SEQ ID NO: 2735 - DNA, 20 bp, Artificial sequence
  Synthetic oligonucleotide
tacacaacagatcccccaag

SEQ ID NO: 2736 - DNA, 20 bp, Artificial sequence
  Synthetic oligonucleotide
ttaattcccacaatccagag

SEQ ID NO: 2737 - DNA, 20 bp, Artificial sequence
  Synthetic oligonucleotide
atcccctttctctcctgttt

SEQ ID NO: 2738 - DNA, 20 bp, Artificial sequence
  Synthetic oligonucleotide
aagaggcctttagaaatggg

SEQ ID NO: 2739 - DNA, 20 bp, Artificial sequence
  Synthetic oligonucleotide
taagaagggaccgcaagagg

SEQ ID NO: 2740 - DNA, 20 bp, Artificial sequence
  Synthetic oligonucleotide
acaattgtaaaatagggcac

SEQ ID NO: 2741 - DNA, 20 bp, Artificial sequence
  Synthetic oligonucleotide
accagtctgctcagtcaaag

SEQ ID NO: 2742 - DNA, 20 bp, Artificial sequence
  Synthetic oligonucleotide
tatcttgtgaccttgtgatt

SEQ ID NO: 2743 - DNA, 20 bp, Artificial sequence
  Synthetic oligonucleotide
gctcactccctgtcaagctg

SEQ ID NO: 2744 - DNA, 20 bp, Artificial sequence
  Synthetic oligonucleotide
aagctctgccagtttaatgt

SEQ ID NO: 2745 - DNA, 20 bp, Artificial sequence
  Synthetic oligonucleotide
agcgatggagcctcagggat

SEQ ID NO: 2746 - DNA, 20 bp, Artificial sequence
  Synthetic oligonucleotide
tgagggaagaatcctctgaa

SEQ ID NO: 2747 - DNA, 20 bp, Artificial sequence
  Synthetic oligonucleotide
acattaagagcagggaacat

SEQ ID NO: 2748 - DNA, 20 bp, Artificial sequence
  Synthetic oligonucleotide
gtgtcacgaaggcccccagg

SEQ ID NO: 2749 - DNA, 20 bp, Artificial sequence
  Synthetic oligonucleotide
ctgcaagccccacctagaag

SEQ ID NO: 2750 - DNA, 20 bp, Artificial sequence
  Synthetic oligonucleotide
tcacaaggccccccttcccc

SEQ ID NO: 2751 - DNA, 20 bp, Artificial sequence
  Synthetic oligonucleotide
gttcggcccctccctgagac

SEQ ID NO: 2752 - DNA, 20 bp, Artificial sequence
  Synthetic oligonucleotide
cccgctgctcctgcactgct

SEQ ID NO: 2753 - DNA, 20 bp, Artificial sequence
  Synthetic oligonucleotide
tgcctgctctttccctcact

SEQ ID NO: 2754 - DNA, 20 bp, Artificial sequence
  Synthetic oligonucleotide
attttattatgaccaccgct

SEQ ID NO: 2755 - DNA, 20 bp, Artificial sequence
  Synthetic oligonucleotide
tcactgttgcacacacacac

SEQ ID NO: 2756 - DNA, 20 bp, Artificial sequence
  Synthetic oligonucleotide
gcaggaggattaagggttgg

SEQ ID NO: 2757 - DNA, 20 bp, Artificial sequence
  Synthetic oligonucleotide
tgggtggccatcaatccttt

SEQ ID NO: 2758 - DNA, 20 bp, Artificial sequence
  Synthetic oligonucleotide
tcagttgcaatctctgtgtt

SEQ ID NO: 2759 - DNA, 20 bp, Artificial sequence
  Synthetic oligonucleotide
atttcctgtctctacctgcc

SEQ ID NO: 2760 - DNA, 20 bp, Artificial sequence
  Synthetic oligonucleotide
gtcctcttctgcctgcccct

SEQ ID NO: 2761 - DNA, 20 bp, Artificial sequence
  Synthetic oligonucleotide
cagggctaccttggagcggt

SEQ ID NO: 2762 - DNA, 20 bp, Artificial sequence
  Synthetic oligonucleotide
tctcacttctctggtgaaag

SEQ ID NO: 2763 - DNA, 20 bp, Artificial sequence
  Synthetic oligonucleotide
agtagcagtaataataatgg

SEQ ID NO: 2764 - DNA, 20 bp, Artificial sequence
  Synthetic oligonucleotide
aatccatgaaaagcacaggg

SEQ ID NO: 2765 - DNA, 20 bp, Artificial sequence
  Synthetic oligonucleotide
ggctctctcatctgtcaaag

SEQ ID NO: 2766 - DNA, 20 bp, Artificial sequence
  Synthetic oligonucleotide
cagacacctctctgtgtcct

SEQ ID NO: 2767 - DNA, 20 bp, Artificial sequence
  Synthetic oligonucleotide
tgtggtgttctctacgggca

SEQ ID NO: 2768 - DNA, 20 bp, Artificial sequence
  Synthetic oligonucleotide
aaatgccccctctacagtgt

SEQ ID NO: 2769 - DNA, 20 bp, Artificial sequence
  Synthetic oligonucleotide
ctctgtgcttttctgcctcc

SEQ ID NO: 2770 - DNA, 20 bp, Artificial sequence
  Synthetic oligonucleotide
tcgggccctcaccctgctca

SEQ ID NO: 2771 - DNA, 20 bp, Artificial sequence
  Synthetic oligonucleotide
ggcgagcggaggcctgggtg

SEQ ID NO: 2772 - DNA, 20 bp, Artificial sequence
  Synthetic oligonucleotide
acctcagcacctagcacaac

SEQ ID NO: 2773 - DNA, 20 bp, Artificial sequence
  Synthetic oligonucleotide
tcaggtctgcaaactaggtg

SEQ ID NO: 2774 - DNA, 20 bp, Artificial sequence
  Synthetic oligonucleotide
ccccgccctcgacccaggtc

SEQ ID NO: 2775 - DNA, 20 bp, Artificial sequence
  Synthetic oligonucleotide
atgagctctaccgtgaggca

SEQ ID NO: 2776 - DNA, 20 bp, Artificial sequence
  Synthetic oligonucleotide
acatctagtgactgcctgct

SEQ ID NO: 2777 - DNA, 20 bp, Artificial sequence
  Synthetic oligonucleotide
aggagtccaatcttggctgg

SEQ ID NO: 2778 - DNA, 20 bp, Artificial sequence
  Synthetic oligonucleotide
tgaagaaagttccaaggagg

SEQ ID NO: 2779 - DNA, 20 bp, Artificial sequence
  Synthetic oligonucleotide
aaagtctaactccatctcct

SEQ ID NO: 2780 - DNA, 20 bp, Artificial sequence
  Synthetic oligonucleotide
cccgccccgcccgagagaga

SEQ ID NO: 2781 - DNA, 20 bp, Artificial sequence
  Synthetic oligonucleotide
aatcatttcagggccaatgc

SEQ ID NO: 2782 - DNA, 20 bp, Artificial sequence
  Synthetic oligonucleotide
atattctagtccagaagaag

SEQ ID NO: 2783 - DNA, 20 bp, Artificial sequence
  Synthetic oligonucleotide
tagcctttctgatgctgaat

SEQ ID NO: 2784 - DNA, 20 bp, Artificial sequence
  Synthetic oligonucleotide
attacctctactagtcagcc

SEQ ID NO: 2785 - DNA, 20 bp, Artificial sequence
  Synthetic oligonucleotide
acctgtgactatctaggatt

SEQ ID NO: 2786 - DNA, 20 bp, Artificial sequence
  Synthetic oligonucleotide
atttatctgtgctttagtga

SEQ ID NO: 2787 - DNA, 20 bp, Artificial sequence
  Synthetic oligonucleotide
acatgtggcacatattagtg

SEQ ID NO: 2788 - DNA, 20 bp, Artificial sequence
  Synthetic oligonucleotide
ctacttctctaggtgggaga

SEQ ID NO: 2789 - DNA, 20 bp, Artificial sequence
  Synthetic oligonucleotide
gagtaagactccgtcgaaag

SEQ ID NO: 2790 - DNA, 20 bp, Artificial sequence
  Synthetic oligonucleotide
tcagcccctctgcaagccct

SEQ ID NO: 2791 - DNA, 20 bp, Artificial sequence
  Synthetic oligonucleotide
tatgagaacctatgcaaccg

SEQ ID NO: 2792 - DNA, 20 bp, Artificial sequence
  Synthetic oligonucleotide
tctcatggactttcagggca

SEQ ID NO: 2793 - DNA, 20 bp, Artificial sequence
  Synthetic oligonucleotide
attacattcagtttccttgc

SEQ ID NO: 2794 - DNA, 20 bp, Artificial sequence
  Synthetic oligonucleotide
aggatcccatctagtggctt

SEQ ID NO: 2795 - DNA, 20 bp, Artificial sequence
  Synthetic oligonucleotide
actaactttaattctctttc

SEQ ID NO: 2796 - DNA, 20 bp, Artificial sequence
  Synthetic oligonucleotide
aaagccctccccatccccaa

SEQ ID NO: 2797 - DNA, 20 bp, Artificial sequence
  Synthetic oligonucleotide
ggtaagctgctggagtaaga

SEQ ID NO: 2798 - DNA, 20 bp, Artificial sequence
  Synthetic oligonucleotide
cttacttttcttgatagtaa

SEQ ID NO: 2799 - DNA, 20 bp, Artificial sequence
  Synthetic oligonucleotide
ctccttaatgacctgcaggg

SEQ ID NO: 2800 - DNA, 20 bp, Artificial sequence
  Synthetic oligonucleotide
ccctcgaatctgcaggttgg

SEQ ID NO: 2801 - DNA, 20 bp, Artificial sequence
  Synthetic oligonucleotide
ttttgccccctcgaatctgc

SEQ ID NO: 2802 - DNA, 20 bp, Artificial sequence
  Synthetic oligonucleotide
cttttgccccctcgaatctg

SEQ ID NO: 2803 - DNA, 20 bp, Artificial sequence
  Synthetic oligonucleotide
gcttttgccccctcgaatct

SEQ ID NO: 2804 - DNA, 20 bp, Artificial sequence
  Synthetic oligonucleotide
gtgcttttgccccctcgaat

SEQ ID NO: 2805 - DNA, 20 bp, Artificial sequence
  Synthetic oligonucleotide
tggtgcttttgccccctcga

SEQ ID NO: 2806 - DNA, 20 bp, Artificial sequence
  Synthetic oligonucleotide
tttggtgcttttgccccctc

SEQ ID NO: 2807 - DNA, 20 bp, Artificial sequence
  Synthetic oligonucleotide
ttaatatttaacattaagag

SEQ ID NO: 2808 - DNA, 20 bp, Artificial sequence
  Synthetic oligonucleotide
acgtcacattcactaatatt

SEQ ID NO: 2809 - DNA, 20 bp, Artificial sequence
  Synthetic oligonucleotide
cacgtcacattcactaatat

SEQ ID NO: 2810-2812 - skipped (3 entries)

SEQ ID NO: 2813 - DNA, 20 bp, Artificial sequence
  Synthetic oligonucleotide
gtggtcctaaatattctagt

SEQ ID NO: 2814-2815 - skipped (2 entries)

SEQ ID NO: 2816 - DNA, 18 bp, Artificial sequence
  Synthetic oligonucleotide
gcagtattacctctacta

SEQ ID NO: 2817 - DNA, 18 bp, Artificial sequence
  Synthetic oligonucleotide
ggcagtattacctctact

SEQ ID NO: 2818 - DNA, 18 bp, Artificial sequence
  Synthetic oligonucleotide
tggcagtattacctctac

SEQ ID NO: 2819 - DNA, 18 bp, Artificial sequence
  Synthetic oligonucleotide
tcagcctggttagccttt

SEQ ID NO: 2820 - DNA, 18 bp, Artificial sequence
  Synthetic oligonucleotide
gtcagcctggttagcctt

SEQ ID NO: 2821 - DNA, 18 bp, Artificial sequence
  Synthetic oligonucleotide
agtcagcctggttagcct

SEQ ID NO: 2822 - DNA, 18 bp, Artificial sequence
  Synthetic oligonucleotide
gtgtattaggatcccatc

SEQ ID NO: 2823 - DNA, 18 bp, Artificial sequence
  Synthetic oligonucleotide
tgtgtattaggatcccat

SEQ ID NO: 2824 - DNA, 18 bp, Artificial sequence
  Synthetic oligonucleotide
gtgtgtattaggatccca

SEQ ID NO: 2825 - DNA, 18 bp, Artificial sequence
  Synthetic oligonucleotide
ttatttttcctcagcgac

SEQ ID NO: 2826 - DNA, 18 bp, Artificial sequence
  Synthetic oligonucleotide
tttatttttcctcagcga

SEQ ID NO: 2827 - DNA, 18 bp, Artificial sequence
  Synthetic oligonucleotide
ctttatttttcctcagcg

SEQ ID NO: 2828 - DNA, 18 bp, Artificial sequence
  Synthetic oligonucleotide
tctttatttttcctcagc

SEQ ID NO: 2829 - DNA, 18 bp, Artificial sequence
  Synthetic oligonucleotide
gtctttatttttcctcag

SEQ ID NO: 2830 - DNA, 18 bp, Artificial sequence
  Synthetic oligonucleotide
tgtctttatttttcctca

SEQ ID NO: 2831 - DNA, 18 bp, Artificial sequence
  Synthetic oligonucleotide
ttgtctttatttttcctc

SEQ ID NO: 2832 - DNA, 18 bp, Artificial sequence
  Synthetic oligonucleotide
tttgtctttatttttcct

SEQ ID NO: 2833 - DNA, 18 bp, Artificial sequence
  Synthetic oligonucleotide
atttgtctttatttttcc

SEQ ID NO: 2834 - DNA, 18 bp, Artificial sequence
  Synthetic oligonucleotide
tgattttccccgtctttg

SEQ ID NO: 2835 - DNA, 18 bp, Artificial sequence
  Synthetic oligonucleotide
gtgattttccccgtcttt

SEQ ID NO: 2836 - DNA, 18 bp, Artificial sequence
  Synthetic oligonucleotide
tgtgattttccccgtctt

SEQ ID NO: 2837 - DNA, 18 bp, Artificial sequence
  Synthetic oligonucleotide
gagatatcttgtgacctt

SEQ ID NO: 2838 - skipped

SEQ ID NO: 2839 - DNA, 18 bp, Artificial sequence
  Synthetic oligonucleotide
ttgagatatcttgtgacc

SEQ ID NO: 2840 - DNA, 18 bp, Artificial sequence
  Synthetic oligonucleotide
cacattcactaatattta

SEQ ID NO: 2841 - DNA, 18 bp, Artificial sequence
  Synthetic oligonucleotide
tcacattcactaatattt

SEQ ID NO: 2842 - DNA, 18 bp, Artificial sequence
  Synthetic oligonucleotide
gtcacattcactaatatt

SEQ ID NO: 2843 - DNA, 18 bp, Artificial sequence
  Synthetic oligonucleotide
catttgtctttatttttc

SEQ ID NO: 2844 - DNA, 18 bp, Artificial sequence
  Synthetic oligonucleotide
gcatttgtctttattttt

SEQ ID NO: 2845 - DNA, 18 bp, Artificial sequence
  Synthetic oligonucleotide
agcatttgtctttatttt

SEQ ID NO: 2846 - DNA, 18 bp, Artificial sequence
  Synthetic oligonucleotide
cagcatttgtctttattt

SEQ ID NO: 2847-2849 - skipped (3 entries)

SEQ ID NO: 2850 - DNA, 18 bp, Artificial sequence
  Synthetic oligonucleotide
ttgtgattttccccgtct

SEQ ID NO: 2851 - DNA, 18 bp, Artificial sequence
  Synthetic oligonucleotide
tttgagatatcttgtgac

SEQ ID NO: 2852 - DNA, 18 bp, Artificial sequence
  Synthetic oligonucleotide
attcactaatatttaaca

SEQ ID NO: 2853 - DNA, 18 bp, Artificial sequence
  Synthetic oligonucleotide
cattcactaatatttaac

SEQ ID NO: 2854 - DNA, 18 bp, Artificial sequence
  Synthetic oligonucleotide
cgtcacattcactaatat

SEQ ID NO: 2855 - skipped

SEQ ID NO: 2856 - DNA, 18 bp, Artificial sequence
  Synthetic oligonucleotide
agcctggttagcctttct

SEQ ID NO: 2857-2858 - skipped (2 entries)

SEQ ID NO: 2859 - DNA, 18 bp, Artificial sequence
  Synthetic oligonucleotide
agtattacctctactagt

SEQ ID NO: 2860 - skipped

SEQ ID NO: 2861 - DNA, 18 bp, Artificial sequence
  Synthetic oligonucleotide
ttggcagtattacctcta

SEQ ID NO: 2862 - DNA, 18 bp, Artificial sequence
  Synthetic oligonucleotide
tattaggatcccatctag

SEQ ID NO: 2863 - DNA, 18 bp, Artificial sequence
  Synthetic oligonucleotide
gtattaggatcccatcta

SEQ ID NO: 2864-2865 - skipped (2 entries)

SEQ ID NO: 2866 - DNA, 18 bp, Artificial sequence
  Synthetic oligonucleotide
gcttttgagatatcttgt

SEQ ID NO: 2867-2872 - skipped (6 entries)

SEQ ID NO: 2873 - DNA, 18 bp, Artificial sequence
  Synthetic oligonucleotide
ccatttatctgtgcttta

SEQ ID NO: 2874 - DNA, 18 bp, Artificial sequence
  Synthetic oligonucleotide
tgccatttatctgtgctt

SEQ ID NO: 2875 - DNA, 18 bp, Artificial sequence
  Synthetic oligonucleotide
ctgccatttatctgtgct

SEQ ID NO: 2876 - DNA, 18 bp, Artificial sequence
  Synthetic oligonucleotide
tctgccatttatctgtgc

SEQ ID NO: 2877-2885 - skipped (9 entries)

SEQ ID NO: 2886 - DNA, 18 bp, Artificial sequence
  Synthetic oligonucleotide
actatctaggatttggca

SEQ ID NO: 2887 - DNA, 18 bp, Artificial sequence
  Synthetic oligonucleotide
tgtgactatctaggattt

SEQ ID NO: 2888 - DNA, 18 bp, Artificial sequence
  Synthetic oligonucleotide
tatctgtgctttagtgac

SEQ ID NO: 2889-2890 - skipped (2 entries)

SEQ ID NO: 2891 - DNA, 18 bp, Artificial sequence
  Synthetic oligonucleotide
gccatttatctgtgcttt

SEQ ID NO: 2892 - DNA, 18 bp, Artificial sequence
  Primer
aaccggatcaccattccc

SEQ ID NO: 2893 - DNA, 20 bp, Artificial sequence
  Primer
ccttgtgattttccccgtct

SEQ ID NO: 2894 - DNA, 22 bp, Artificial sequence
  Probe
tgcttttgccccctcgaatctg

SEQ ID NO: 2895 - DNA, 18 bp, Artificial sequence
  Primer
aaccggatcaccattccc

SEQ ID NO: 2896 - DNA, 21 bp, Artificial sequence
  Primer
gtcttcaccacgatgttcctc

SEQ ID NO: 2897 - DNA, 24 bp, Artificial sequence
  Probe
caccaagtctgtgtcagaaggcca

SEQ ID NO: 2898 - DNA, 19 bp, Artificial sequence
  Primer
gaaggtgaaggtcggagtc

SEQ ID NO: 2899 - DNA, 20 bp, Artificial sequence
  Primer
gaagatggtgatgggatttc

SEQ ID NO: 2900 - DNA, 20 bp, Artificial sequence
  Probe
caagcttcccgttctcagcc

The invention claimed is:
1. A modified oligonucleotide according to the following chemical structure:

(SEQ ID NO: 20)

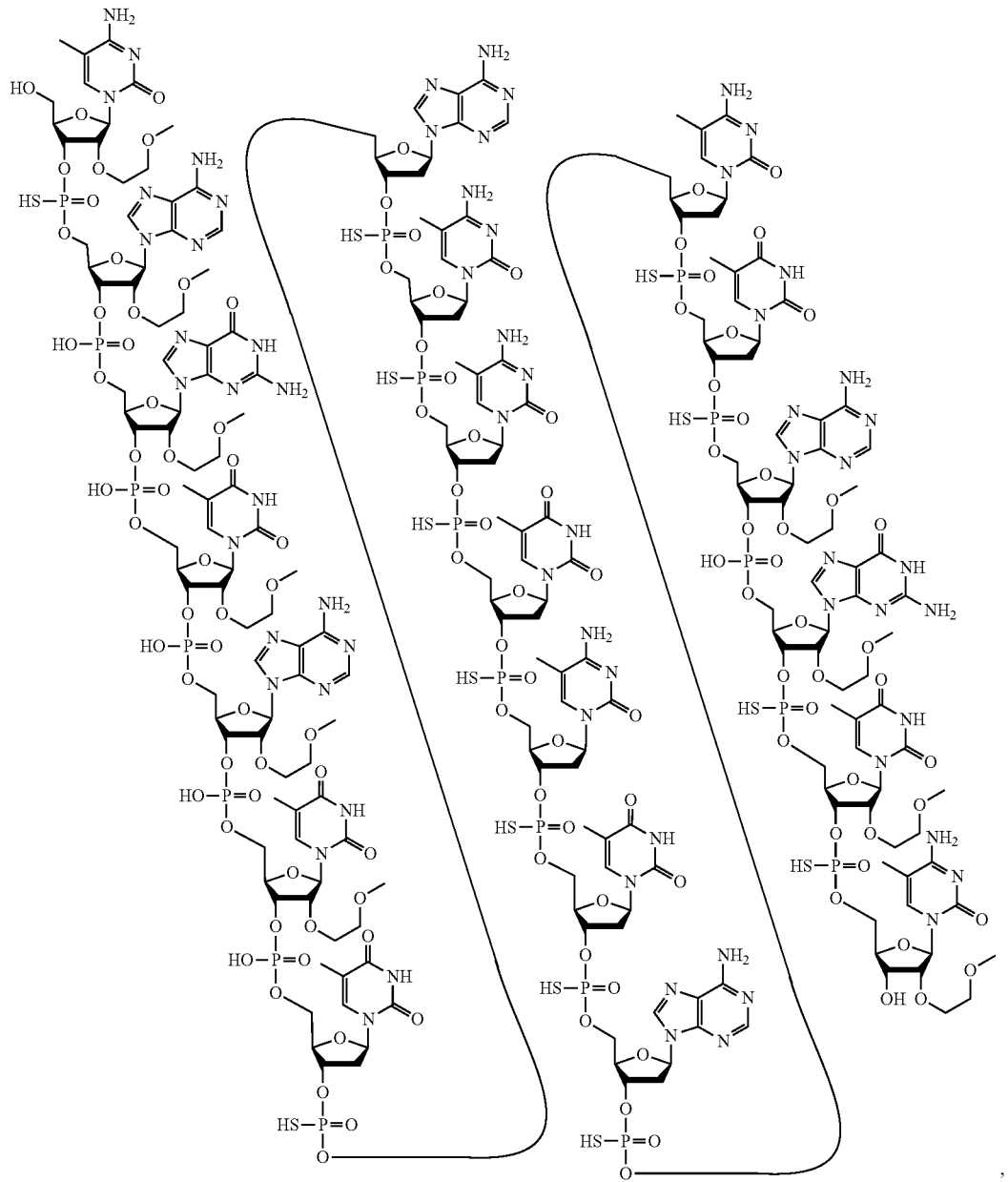

or a salt thereof.

2. A modified oligonucleotide according to the following chemical structure:

(SEQ ID NO: 20)

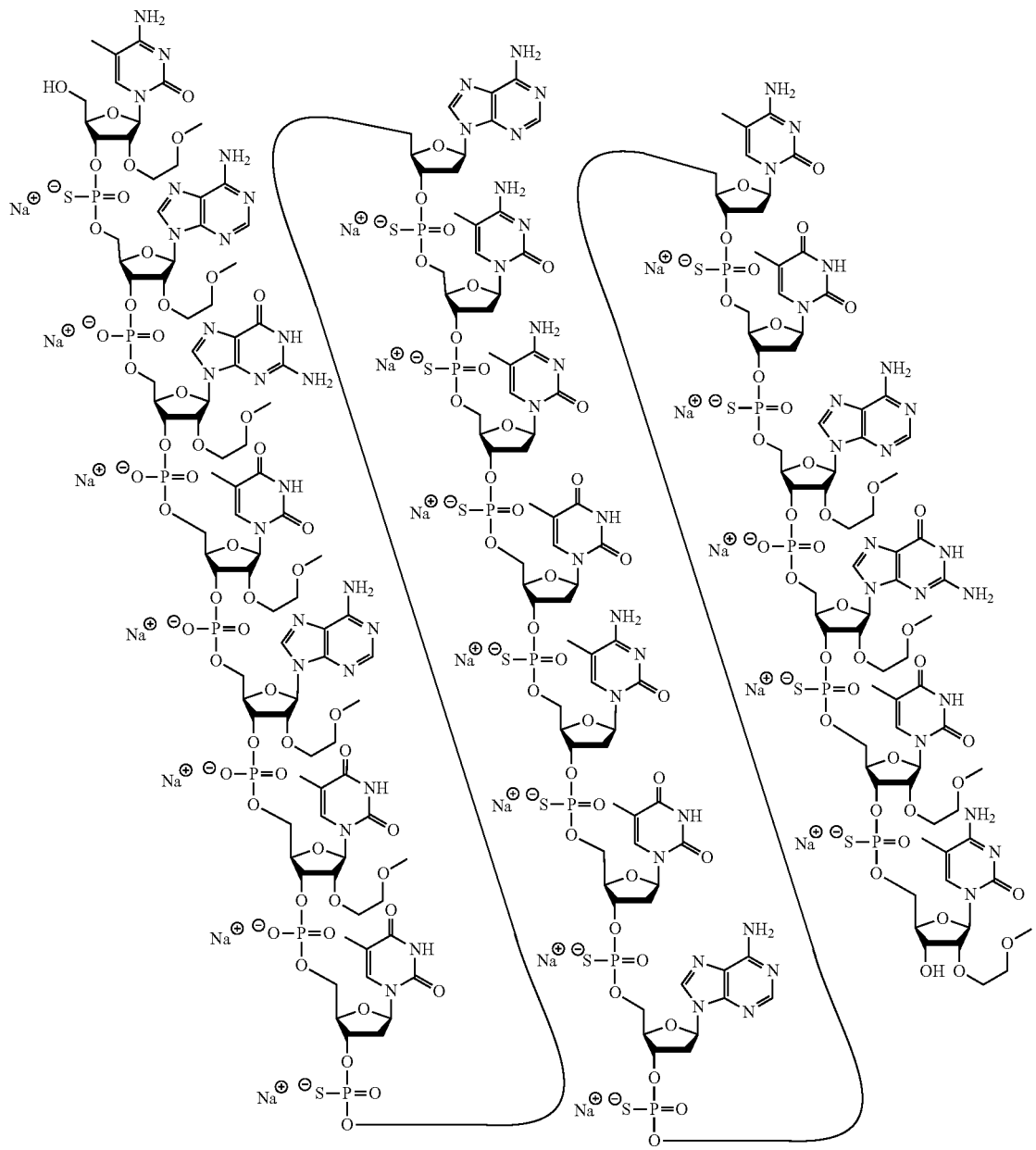

3. The modified oligonucleotide of claim 1, which is the sodium salt or the potassium salt.

4. A pharmaceutical composition comprising the modified oligonucleotide of claim 1 and a pharmaceutically acceptable diluent.

5. The pharmaceutical composition of claim 4, wherein the pharmaceutically acceptable diluent is artificial cerebrospinal fluid or phosphate-buffered saline (PBS).

6. The pharmaceutical composition of claim 5, wherein the pharmaceutical composition consists of the modified oligonucleotide and artificial cerebrospinal fluid.

7. An oligomeric compound comprising a modified oligonucleotide according to the following chemical notation: $^{m}C_{es}A_{eo}G_{eo}T_{eo}A_{eo}T_{eo}T_{ds}A_{ds}{}^{m}C_{ds}{}^{m}C_{ds}T_{ds}{}^{m}C_{ds}T_{ds}A_{ds}{}^{m}C_{ds}T_{ds}A_{eo}G_{es}T_{es}{}^{m}C_{e}$ (SEQ ID NO: 20) wherein:
A=an adenine nucleobase,
$^{m}C$=a 5-methylcytosine nucleobase,
G=a guanine nucleobase,
T=a thymine nucleobase,
e=a 2'-β-D-MOE sugar moiety,
d=a 2'-β-D-deoxyribosyl sugar moiety,
s=a phosphorothioate internucleoside linkage, and
o=a phosphodiester internucleoside linkage.

8. The oligomeric compound of claim 7, comprising the modified oligonucleotide covalently linked to a conjugate group.

9. A pharmaceutical composition comprising the oligomeric compound of claim 7, and a pharmaceutically acceptable diluent.

10. The pharmaceutical composition of claim 9, wherein the pharmaceutically acceptable diluent is artificial cerebrospinal fluid or PBS.

11. The pharmaceutical composition of claim 10, wherein the pharmaceutical composition consists of the oligomeric compound and artificial cerebrospinal fluid.

12. A method comprising administering to an individual the pharmaceutical composition of claim 4.

13. A method of treating Alexander disease a disease, comprising administering to an individual having or at risk of having Alexander disease a therapeutically effective amount of the pharmaceutical composition according to claim 4, thereby treating Alexander disease.

14. The method of claim 13, wherein at least one symptom or hallmark of Alexander disease is ameliorated.

15. The method of claim 14, wherein at least one symptom or hallmark is one or more of motor delays, cognitive delays, paroxysmal deterioration, seizures, vomiting, swallowing difficulties, ataxic gait, palatal myoclonus, autonomic dysfunction, or the presence of intra-astrocytic inclusions called Rosenthal fibers.

16. The method of claim 13, wherein the pharmaceutical composition is administered to the central nervous system or systemically.

17. The method of claim 13, wherein the pharmaceutical composition is administered to the central nervous system and systemically.

18. The pharmaceutical composition of claim 5, wherein the pharmaceutical composition consists essentially of the modified oligonucleotide and artificial cerebrospinal fluid.

19. The pharmaceutical composition of claim 10, wherein the pharmaceutical composition consists essentially of the oligomeric compound and artificial cerebrospinal fluid.

20. The pharmaceutical composition of claim 5, wherein the pharmaceutical composition consists essentially of the modified oligonucleotide and PBS.

21. The pharmaceutical composition of claim 10, wherein the pharmaceutical composition consists essentially of the oligomeric compound and PBS.

22. A pharmaceutical composition comprising the modified oligonucleotide of claim 2 and a pharmaceutically acceptable diluent.

23. The pharmaceutical composition of claim 22, wherein the pharmaceutically acceptable diluent is artificial cerebrospinal fluid or PBS.

24. The pharmaceutical composition of claim 23, wherein the pharmaceutical composition consists essentially of the modified oligonucleotide and artificial cerebrospinal fluid.

25. The pharmaceutical composition of claim 23, wherein the pharmaceutical composition consists essentially of the modified oligonucleotide and PBS.

26. A pharmaceutical composition comprising the modified oligonucleotide of claim 3 and a pharmaceutically acceptable diluent.

27. The pharmaceutical composition of claim 26, wherein the pharmaceutically acceptable diluent is artificial cerebrospinal fluid or PBS.

28. The pharmaceutical composition of claim 27, wherein the pharmaceutical composition consists essentially of the modified oligonucleotide and artificial cerebrospinal fluid.

29. The pharmaceutical composition of claim 27, wherein the pharmaceutical composition consists essentially of the modified oligonucleotide and PBS.

30. A population of modified oligonucleotides of claim 1, wherein all of the phosphorothioate internucleoside linkages of the modified oligonucleotide are stereorandom.

31. A population of modified oligonucleotides of claim 2, wherein all of the phosphorothioate internucleoside linkages of the modified oligonucleotide are stereorandom.

32. A population of modified oligonucleotides of claim 3, wherein all of the phosphorothioate internucleoside linkages of the modified oligonucleotide are stereorandom.

33. A population of oligomeric compounds of claim 7, wherein all of the phosphorothioate internucleoside linkages of the modified oligonucleotide are stereorandom.

34. A pharmaceutical composition comprising the population of modified oligonucleotides of claim 30 and a pharmaceutically acceptable diluent.

35. The pharmaceutical composition of claim 34, wherein the pharmaceutically acceptable diluent is artificial cerebrospinal fluid or PBS.

36. A pharmaceutical composition comprising the population of modified oligonucleotides of claim 31 a pharmaceutically acceptable diluent.

37. The pharmaceutical composition of claim 36, wherein the pharmaceutically acceptable diluent is artificial cerebrospinal fluid or PBS.

38. A pharmaceutical composition comprising the population of modified oligonucleotides of claim 32 and a pharmaceutically acceptable diluent.

39. The pharmaceutical composition of claim 38, wherein the pharmaceutically acceptable diluent is artificial cerebrospinal fluid or PBS.

40. A pharmaceutical composition comprising the population of oligomeric compounds of claim 33 and a pharmaceutically acceptable diluent.

41. The pharmaceutical composition of claim 40, wherein the pharmaceutically acceptable diluent is artificial cerebrospinal fluid or PBS.

42. The method of claim 12, wherein the individual has or is at risk of having Alexander disease.

* * * * *

UNITED STATES PATENT AND TRADEMARK OFFICE
CERTIFICATE OF CORRECTION

Page 1 of 3

PATENT NO. : 11,786,546 B2
APPLICATION NO. : 16/938826
DATED : October 17, 2023
INVENTOR(S) : Berit Elissa Powers and Frank Rigo It is certified that error appears in the above-identified patent and that said Letters Patent is hereby corrected as shown below:

In the Specification

Columns 69-70, the sodium salt of Compound No. 1166985, that portion of the formula reading

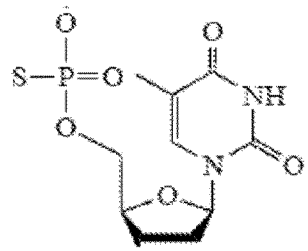     should read     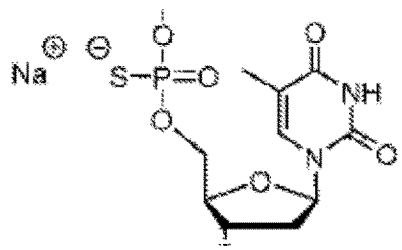

Columns 75-76, Compound No. 1072813, that portion of the formula reading

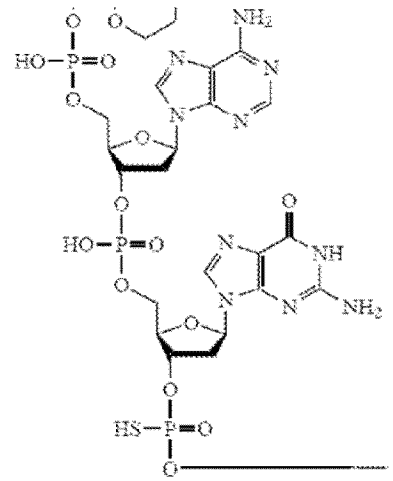     should read     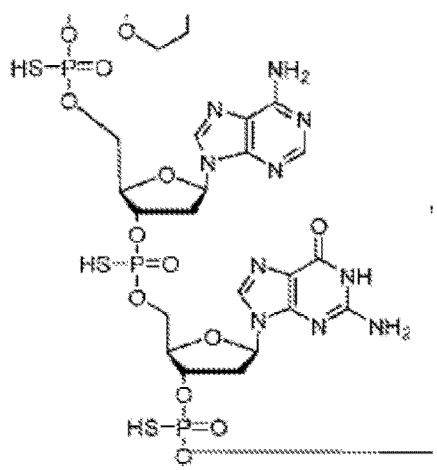

Signed and Sealed this
Twenty-sixth Day of December, 2023

Katherine Kelly Vidal
*Director of the United States Patent and Trademark Office*

CERTIFICATE OF CORRECTION (continued)
U.S. Pat. No. 11,786,546 B2

Columns 77-78, the sodium salt of Compound 1072813, that portion of the formula reading

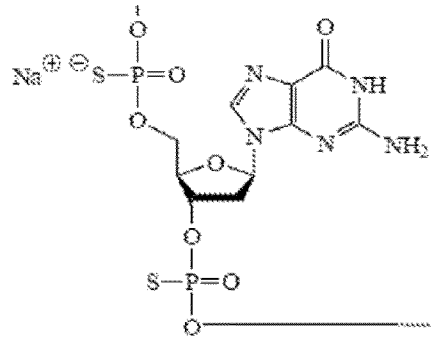 should read 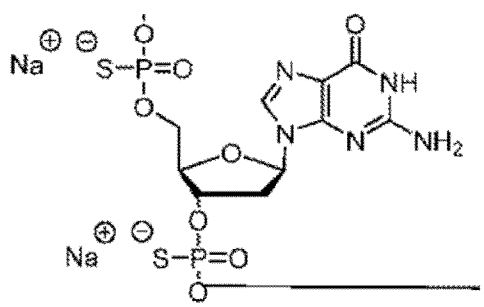

Columns 81-82, the sodium salt of Compound 1199983, that portion of the formula reading

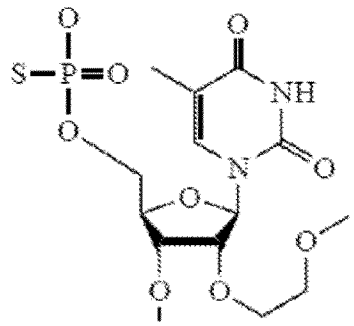 should read 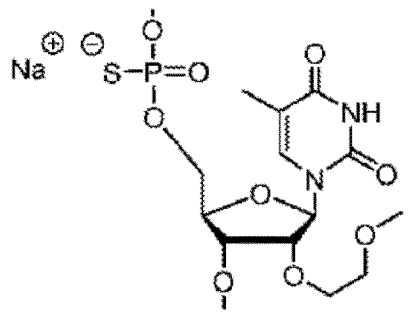

Columns 85-86, Compound 1166721, that portion of the formula reading

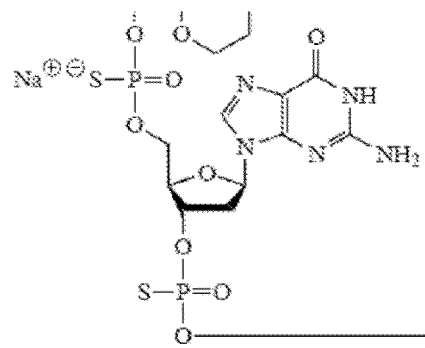 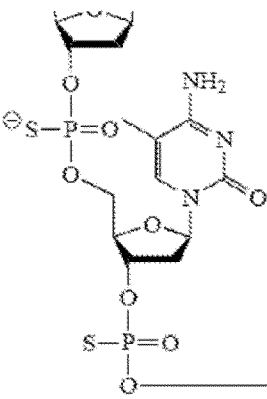 should read

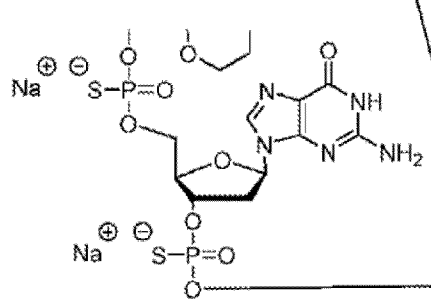 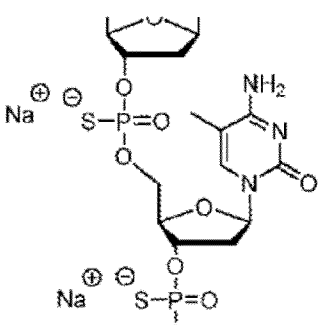

CERTIFICATE OF CORRECTION (continued)
U.S. Pat. No. 11,786,546 B2

In the Claims

Column 315, Line 15, in Claim 13: delete "A method of treating Alexander disease a disease, comprising" and replace it with "A method of treating Alexander disease, comprising"

Column 316, Lines 35-36, in Claim 36: delete "of claim 31 a pharmaceutically acceptable diluent" and replace it with "of claim 31 and a pharmaceutically acceptable diluent"